(12) United States Patent
Brown et al.

(10) Patent No.: US 10,174,317 B2
(45) Date of Patent: Jan. 8, 2019

(54) RECOMBINANT RNA PARTICLES AND METHODS OF USE

(71) Applicant: Synthetic Genomics, Inc., La Jolla, CA (US)

(72) Inventors: Robert C. Brown, San Diego, CA (US); Kurt I. Kamrud, Apex, NC (US)

(73) Assignee: Synthetic Genomics, Inc., La Jolla, CA (US)

( * ) Notice: Subject to any disclaimer, the term of this patent is extended or adjusted under 35 U.S.C. 154(b) by 0 days.

(21) Appl. No.: 14/622,671

(22) Filed: Feb. 13, 2015

(65) Prior Publication Data
US 2015/0240236 A1    Aug. 27, 2015

Related U.S. Application Data

(60) Provisional application No. 61/939,718, filed on Feb. 13, 2014.

(51) Int. Cl.
*C12N 15/113* (2010.01)
*C12N 15/86* (2006.01)

(52) U.S. Cl.
CPC ............ *C12N 15/113* (2013.01); *C12N 15/86* (2013.01); *C07K 2319/40* (2013.01); *C07K 2319/60* (2013.01); *C12N 2310/14* (2013.01); *C12N 2320/32* (2013.01); *C12N 2720/00022* (2013.01); *C12N 2720/00043* (2013.01)

(58) Field of Classification Search
None
See application file for complete search history.

(56) References Cited

U.S. PATENT DOCUMENTS

| | | | |
|---|---|---|---|
| 6,451,304 | B1 | 9/2002 | Friedmann et al. |
| 7,485,440 | B2 | 2/2009 | Collins et al. |
| 8,183,044 | B2 | 5/2012 | Tanabe et al. |
| 8,592,205 | B2 | 11/2013 | Pinschewer et al. |
| 8,617,533 | B2 | 12/2013 | Smith et al. |
| 2008/0226601 | A1 | 9/2008 | Federoff et al. |
| 2009/0075370 | A1 | 3/2009 | Wilkes et al. |
| 2013/0045223 | A1 | 2/2013 | Loy et al. |
| 2013/0122025 | A1 | 5/2013 | Harris et al. |
| 2017/0044555 | A1* | 2/2017 | Brown ............... C12N 15/81 |

FOREIGN PATENT DOCUMENTS

WO    WO 2004/041851 A2    5/2004

OTHER PUBLICATIONS

Wu et al. Inhibition of White Spot Syndrome Virus in Litopenaeus vannamei shrimp by sequence-specific siRNA. Oct. 2007. Aquaculture. vol. 271 pp. 21-30.*
Pearson, William R. An Introduction to Sequence Similarity ("Homology") Searching. Jun. 2013. Current Protocols in Bioinformatics. 8 pages.*
KY489962.1. *Saccharomyces* paradox virus L-A-21 gag-pol fusion protein and major virion coat protein genes, complete cds. Oct. 25, 2017. 3 pages. (Year: 2017).*
KY489963.1. *Saccharomyces* paradoxus virus L-A-45 gag-pol fusion protein and major virion coat protein genes, complete cds. Oct. 25, 2017. 3 pages. (Year: 2017).*
KY489969.1, *Saccharomyces* uvarum virus L-A-10560 gag-pol fusion protein and major virion coat protein genes, complete cds. Oct. 25, 2017. 3 pages. (Year: 2017).*
GenBank: AF440570.1. "Shrimp white spot syndrome virus, complete genome" [online] Mar. 15, 2005, pp. 1-9 Available on the internet: <URL:http://www.ncbi.nlm.nih.gov/nuccore/AF440570.1>.
Jariyapong et al.: "*Delivery of double stranded RNA by Macrobrachium rosenbergii nodavirus—like particles to protect shrimp from white spot syndrome virus.*"; Aquaculture ePub, Sep. 26, 2014 vol. 435, No. 1, pp. 86-91.
Naitow et al.: "*L-A viruresolution reveals particle architecture and mRNA decapping mechanism.*"; Nat Struct Biol, Oct. 2002, vol. 9, No. 10, pp. 725-728.
International Search Report dated Aug. 12, 2015, regarding PCT/US2015/015941. 14 pages.
Aalto, Antti P. et al.: "*Large-scale production of dsRNA and siRNA pools for RNA interference utilizing bacteriophage ϕ6 RNA-dependent RNA polymerase*"; RNA (2007), 13:422-429.
Berglund, Peter et al.: "*Semliki Forest Virus Expression System: Production of Conditionally Infectious Recombinant Particles*"; BioTechnonogy, vol. 11, Aug. 1993, pp. 916-920.
Kamrud, Kurt, I. et al.: *In Vitro and In Vivo Characterization of MicroRNA-Targeted Alphavirus Replicon and Helper RNAs⁻*; Journal of Virology, Aug. 2010, vol. 84, No. 15, p. 7713-7725.
Lundstrom, Kenneth: "*Alphavirus Vectors for Therapy of Neurological Disorders*"; J Stem Cell Res Ther (2012), p. 1-5.
Powilleit, Frank et al.: "*Exploiting the Yeast L-A Viral Capsid for the In Vivo Assembly of Chimeric VLPs as Platform in Vaccine Development and Foreign Protein Expression*"; PLoS ONE, May 2007, issue 5, p. 1-12.
Rodriguez-Cousiño, Nieves et al.: "*L-A-lus, a New Variant of the L-A Totivirus Found in Wine Yeasts with Klus Killer Toxin-Encoding Mlus Double-Stranded RNA: Possible Role of Killer Toxin-Encoding Satellite RNAs in the Evolution of Their Helper Viruses*"; Applied and Environmental Microbiology, Aug. 2013, vol. 79 No. 15, p. 4661-4674.

(Continued)

Primary Examiner — Channing S Mahatan
(74) Attorney, Agent, or Firm — DLA Piper LLP (US)

(57) ABSTRACT

The present invention provides compositions and methods for the production and delivery of recombinant double-stranded RNA molecules (dsRNA) targeting pathogen sequences, which can be useful as an RNA vaccine. The compositions contain engineered double-stranded RNA particles (dsRPs) that can contain a double-stranded RNA molecule that can be a genome or portion of a genome, which can be enclosed in a capsid or coat protein. The dsRNA molecule also comprises an RNA sub-sequence that binds to a target sequence of a pathogenic organism. The dsRPs can be derived from wild-type viral organisms. The delivery of the dsRPs of the invention to an organism provides a protection to the organism from the pathogen.

31 Claims, 10 Drawing Sheets

Figure 1:
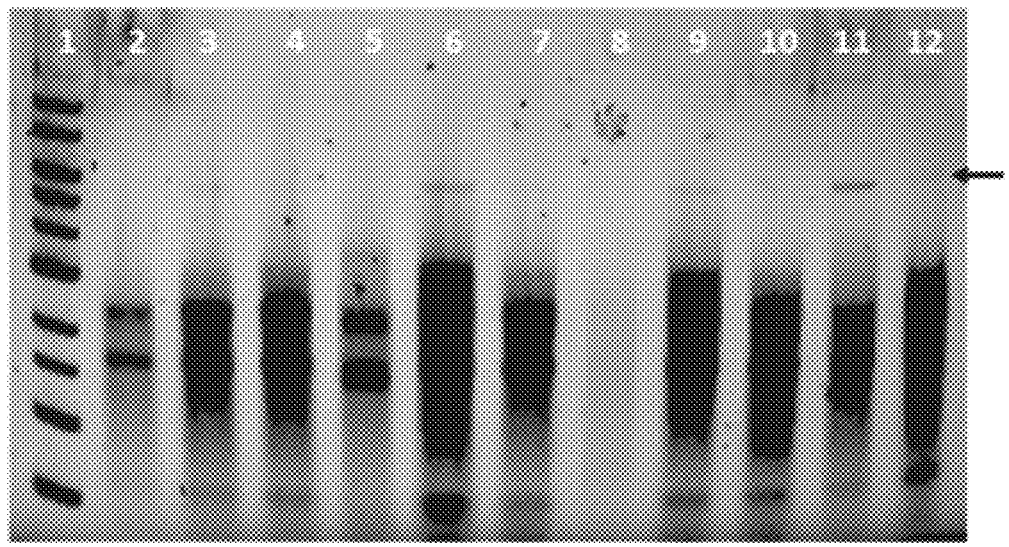

Specification includes a Sequence Listing.

(56) References Cited

OTHER PUBLICATIONS

Schlake, Thomas et al.: "*Developing mRNA-vaccine technologies*" RNA Biology, 9:11, Nov. 2012, p. 1319-1330.
Schmitt, Manfred J. et al.: "*Yeast viral killer toxins: lethality and self-protection*"; Applied Molecular Biology, Mar. 2006, V. 4, p. 212-221.
Stentiford, G. D.et al.: "*Disease will limit future food supply from the global crustacean fishery and aquaculture sectors*"; Journal of Invertebrate Pathology, 110 (2012) p. 141-157.
Ulmer, Jeffrey B. et al.: "*RNA-based vaccines*"; Vaccine, 30 (2012) 4414-4418.
Wickner, Reed B.: *Double-Stranded and Single-Stranded RNA Viruses of Saccharomyces Cerevisiae* Annu . Rev. Microbiol. 1992. 46:347-75.
Kanhayuwa, Lakkhana et al.: "*A novel mycovirus from Aspergillus fumigatus contains four unique dsRNAs as its genome and is infectious as dsRNA*"; PNAS 1419225112, Jun. 3, 2015, p. 1-6.

\* cited by examiner

RECOMBINANT RNA PARTICLES AND METHODS OF USE

RELATED APPLICATIONS

This application claims the benefit of U.S. Ser. No. 61/939,718, filed Feb. 13, 2014, which is hereby incorporated by reference in its entirety, including all tables, figures, and claims.

FIELD OF THE INVENTION

The invention pertains to a dsRNA particles, recombinant dsRNA molecules, and methods of production and use.

INCORPORATION OF SEQUENCE LISTING

The material in the accompanying sequence listing is hereby incorporated by reference into this application. The accompanying sequence listing text file, name SGI1780_1WO_Sequence_Listing, was created on 13 Feb. 2015, and is 109 kb. The file can be assessed using Microsoft Word on a computer that uses Windows OS

BACKGROUND OF THE INVENTION

Engineered viral systems present great opportunities for therapeutic applications. The genomes of many viruses have been sequenced and characterized with respect the replication, packaging, immune evasion, protective antigens, killer toxin, immunity proteins, etc. Utilizing this information, viruses have been altered for use as attenuated vaccines or engineered for use as protein expression systems for use in gene therapy, vaccines and protein products. Examples of viruses that have been used in this manner include alphaviruses, adenoviruses, baculoviruses, pox viruses, rhabdoviruses, picornaviruses, noroviruses, niedoviruses, nidoviruses, and flaviviruses.

As described above, viral systems have been effectively used as vaccines, primarily based on protein expression and presentation to the immune system. It has recently been discovered that dsRNA specific to genetic sequences can control or prevent gene expression. This has broad utility for products in agriculture, aquaculture, veterinary and human therapeutics and vaccines. To date the delivery of dsRNA has been primarily accomplished by technologies that artificially associate dsRNA in particles using lipids, polymers, and recombinant proteins mixed with other molecules like cholesterol and targeting ligands. In addition to these in vitro particulate approaches, direct conjugates of dsRNA to targeting ligands are also being developed. Furthermore dsRNA has been delivered through recombinant plant and *E. coli* material, direct injection, oral exposure, electroporation or immersion of purified dsRNA. However, each of these systems has significant limitations in efficacy, consistency, toxicity, delivery, stability, cost-of goods, manufacturing feasibility etc. This is further illustrated by the fact that there are no licensed products on the market for human, animal or insect applications.

It would therefore be advantageous to be able to engineer and utilize dsRNA viruses naturally found in a wide variety of yeast or fungi to deliver and/or propagate a recombinant dsRNA molecule in a virus or particle, which could be introduced into an organism to be treated to regulate gene expression in the organism or in a pathogen infecting the organism. With such compositions and methods, a highly useful system for efficient production and delivery of packaged dsRNA could be achieved.

SUMMARY OF THE INVENTION

The present invention provides compositions and methods for the production and delivery of recombinant double-stranded RNA molecules (dsRNA). The compositions contain an engineered double-stranded RNA particle (dsRP) of the invention. The dsRP can contain a dsRNA molecule enclosed in a capsid or coat protein. The dsRNA molecule can be a genome or portion of a genome but also comprises an RNA sub-sequence that binds to a target sequence such as, for example, an RNA sequence of a pathogenic organism or an RNA sequence coded by a gene to be silenced. When the dsRP is administered to an organism the sub-sequence is liberated and is available to bind to the target sequence. The delivery of the dsRP to the organism to be treated can provide a protection to the organism from a pathogen by binding to a critical nucleic acid sequence of the pathogen that is present in the organism to be protected. The amplification of the dsRNA molecules utilizes the natural production and assembly processes already present in many types of host cells (e.g., yeast). The invention can thus be applied by presenting to a host cell a single-stranded or double-stranded RNA or DNA molecule of the invention, which is taken up by the host cell and is utilized to produce the recombinant dsRP of the invention. The invention can also be applied by providing to the host cell a linear or circular DNA molecule (e.g., a plasmid) containing one or more sequences for the production of the dsRNA particle having the having the dsRNA having the sub-sequence that binds to a target. The introduction of a DNA molecule or ssRNA or dsRNA molecule as described therefore generates recombinant dsRPs that can be produced under conventional conditions (e.g., yeast fermentation). The compositions are useful for therapeutics and vaccines where the RNA target is from the organism to be treated or from a pathogen that can impact the organism, respectively.

In a first aspect the present invention provides a double-stranded RNA particle (dsRP) having a recombinant double-stranded RNA molecule (dsRNA) that contains at least one heterologous sub-sequence of RNA that binds to a target sequence. The dsRNA particle can be derived from L-A virus and can be less than 100 nm in diameter. The dsRNA molecule can be less than about 6 kb. In one embodiment the dsRNA molecule contains RNA encoding for a Gag-Pol fusion protein, and can be encapsidated in a capsid. The target sequence can be an RNA sequence coded for by a pathogen genome. In one embodiment the target sequence is a critical gene of the pathogen or a portion thereof, or can also be a regulatory element of a gene that codes for a critical pathogen protein. In some embodiments the sub-sequence of RNA binds to an RNA target sequence and disrupts a critical function of a pathogen. The sub-sequence of RNA can also bind to an RNA target that is a unique sequence in a pathogen genome.

In one embodiment the target sequence is an RNA sequence of a pathogen that causes Infectious Pancreatic Necrosis (IPN) disease in salmonid fish, and in other embodiments can be an RNA sequence of a pathogen that causes white spot syndrome (WSS) in penaeid shrimp. In specific embodiments the target sequence is an RNA sequence coded for by a sequence selected from the group consisting of an at least 10 bp portion of any one or more of a nucleotide sequence found in one or more of SEQ ID NOs:

2-103. The target sequence is an RNA sequence of a pathogen that causes disease in an animal of the genus Sirs.

Figure 11A:
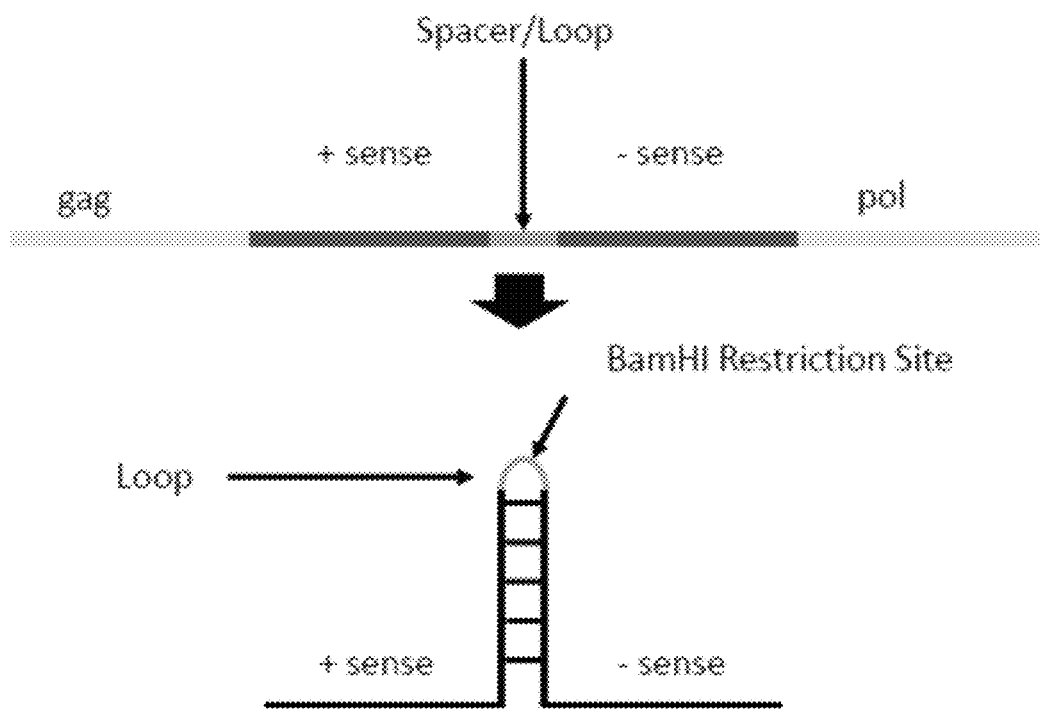
Figure 11B:
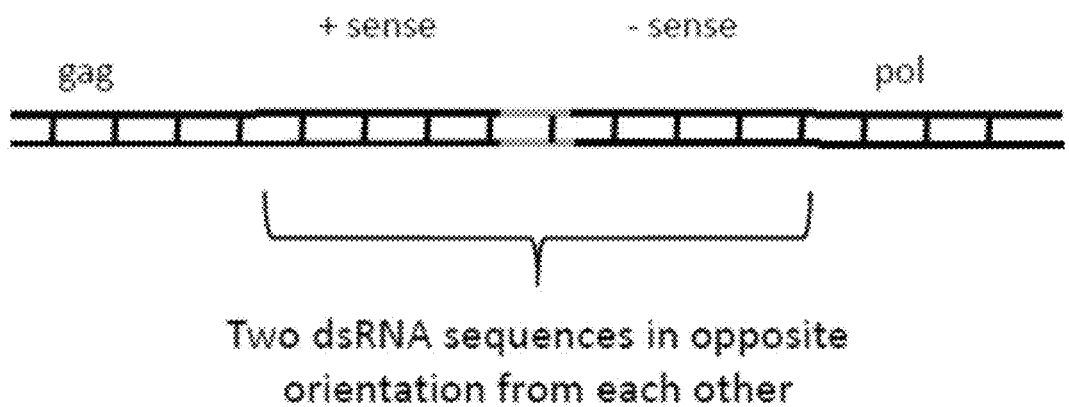

The dsRNA particle of the invention can provide an at least partial immunity in the salmonid fish against IPN for at least 60 days, or at least 75 days. The dsRNA particle can also provide an at least partial immunity in the penaeid shrimp against WSS for at least 7 days, or for at least 90 days. In another embodiment the dsRNA particle provides an at least partial immunity in the animal of the genus *Sus* against said disease for at least 60 days.

The invention also provides formulations that comprise a dsRNA particle of the invention.

In another aspect the invention provides methods of treating an animal disease. The methods involve administering to an animal to be treated a double-stranded RNA particle (dsRP) of the invention. The formulations and vaccines of the invention can be administered to any animal, and non-limiting examples include a peneid shrimp, a salmonid fish, or an animal of the genus *Sus*.

In another aspect the invention provides methods of producing a dsRNA particle. The method involves presenting to a host cell an RNA molecule comprising a sub-sequence that binds to an RNA target sequence, or a DNA molecule encoding an RNA molecule having a sub-sequence that binds to an RNA target sequence. Conditions are then provided such that the host cell takes up the RNA molecule or DNA molecule encoding an RNA molecule, and components of the host cell participate in the production of a dsRNA particle. dsRNA particles can then be harvested from the host cell. The dsRNA particle can have or contain an RNA molecule having the RNA sub-sequence that binds to a target sequence.

In various embodiments the host cell can be a yeast cell of a genus selected from *Saccharomyces, Zygosaccharomyces*, and *Candida*. The step of presenting the RNA molecule can mean presenting a single-stranded RNA molecule. The dsRNA particle can derived from L-A virus, or from bacteriophage ϕ6, or from a variety of other wild-type or natural viruses. The dsRNA molecule can code for an RNA-dependent RNA polymerase. The step of harvesting the dsRP can involve inducing viral burst. The dsRNA molecule can also have a selection marker, and the method can include a selection step for the selection marker. The step of harvesting can also include the retrieval of whole host cells, and can further include rupturing the whole host cells and purifying the dsRNA particle.

DESCRIPTION OF THE DRAWINGS

FIG. 1 illustrates agarose gel electrophoresis on 0.8% E-GEL (Life Technologies Inc.) of ATCC *Saccharomyces cerevisiae* strains total RNA preparations. Lane 1. 1 kb DNA ladder, 2. ATCC 42016, 3. ATCC 46307, 4. ATCC 208717, 5. CEN.PK2-1C, 6. ATCC 208718, 7. ATCC 44827, 8. ATCC 42015, 9. ATCC 46304, 10. ATCC 46305. 11. ATCC 42950. 12. ATCC 42017. Sample in lanes 3, 6, 9, 11 and 12 show dsRNA.

FIG. 2 shows a TEM image of capsids isolated from *Saccharomyces cerevisiae* ATCC208718.

FIG. 3A shows recombinant *Saccharomyces cerevisiae* colonies transformed with GAG:RFP construct and control vector (no GAG:RFP). The fluorescent phenotype is indicative of dsRP incorporating the expressed fusion from the transformed plasmid. FIG. 3B shows the same colonies in the centrifuge tube.

FIG. 4 provides a diagram of the first 480 amino acid residues of the GAG protein showing the hydrophobic residues for potential for exposed epitopes. Regions that maximize hydrophilicity (H), antigenicity (A), and surface probability (SP), but excluded regions that do not contain turns or that contain glycosylation sites. The H, A, and SP are evaluated on a scale of one to ten, ten being the highest. Peptide 1 at Residue 2: LRFVTKNSQDKSSD, 1 turn, H: 8, A: 7, SP: 8; Peptide 2 at Residue 172: FAWPSDRSTDSYPD, 1 turn, H: 7, A: 7, SP: 6. Peptide 3 at Residue 249: QDADEWIEGDRTDD, 1 turn, H: 7, A: 7, SP: 7. Based on these plots 3 potential peptides sequences were highlighted for synthesis and subsequent antibody production with ProSci Inc (Poway Calif.). Peptides 2 and 3 were progressed for synthesis, immunization and polyclonal IgG production.

FIG. 5 illustrates a western blot of *S. cerevisiae* Capsid (GAG) protein of NUPAGE® 4-20% electrophoresis gel (Life Technologies Corp., Carlsbad, Calif.) with MES buffer Lane 1. SEEBLUE® Plus2 Pre-Stained Standard (Life Technologies Corp., Carlsbad, Calif.) Lanes 2-5. Whole cell extracts Lane 2. CEN.PK2-1C with p416TEF vector control. 3. *S. cerevisiae* CEN.PK2-1C with p416TEF-GAG:RFP. 4. ATCC 42950 5. ATCC 208718. Lanes 6-9. Sucrose gradient fractions; Lane 6. ATCC 42950, 7. ATCC 208718, 8. ATCC 46307.

FIG. 6A illustrates: a Western blot and FIG. 6B illustrates: RNA analysis from Sucrose gradient ultracentrifugation samples, profile of recombinant. The upper and lower bands analyzed for Capsid and dsRNA. Lane A1. Standards (PRECISION PLUS PROTEIN™ WESTERNC™), B1. 1 kb NEB DNA Standard 2. CEN.PK2-1C p416TEF-GAG:RFP, 3. ATCC 208718 p41KanMX-TEF-GAG:RFP colony 1 top layer, 4. ATCC 208718 p41KanMX-TEF-GAG:RFP colony 1 lower layer, 5. ATCC 208718 p41KanMX-TEF-GAG:RFP colony 3 top layer. 6. ATCC 208718 control. In lanes 3 and 4 a feint dsRNA band can be observed. Obviously the overexpression of GAG:RFP monomers and subsequent dsRP assembled had little packaged genome.

FIG. 7 is a sucrose gradient profile of recombinant *Saccharomyces cerevisiae* spheroplasts post cushion gradient (45%). Samples were fractionated into 2 red fluorescent bands on a 20-70% linear density gradient. The upper and lower bands were removed by syringe for further characterization. Sample 1. CEN.PK2-1C p416TEF-GAG:RFP, 2. ATCC 208718 p41KanMX-TEF-GAG:RFP colony 1, 3. ATCC 208718 p41KanMX-TEF-GAG:RFP colony 3.

FIG. 8 is a graphical Illustration of the in vitro synthesis of a dsRNA fragment. The template for synthesis could be a plasmid or PCR fragment (including synthetic assembly). In this case the diagram depicts the synthesis of dsRNA encoding red fluorescent protein (RFP).

FIG. 9 is a schematic illustration of dsRNA vectors that have been examined for the ability to replicate in yeast when the gag and gag-pol proteins are provided in trans from plasmid DNA.

FIG. 10A is an illustration of a dsRNA molecule of the invention derived from wild-type L-A virus that can show an expected RNAi effect. Shown is an RNA sub-sequence (center) coding for the target 1100 bp of the shrimp clotting protein gene. This was constructed as L-A v5 clot. FIG. 10B shows the results of knock down of the endogenous shrimp clotting protein gene by injection.

FIG. 11A illustrates an embodiment of the invention utilizing a hairpin structure. A spacer sequence that forms the hairpin loop is depicted and a first and second RNA sub-sequence is depicted that are separated by the spacer sequence and that are the reverse complement to one another and that will form the dsRNA hairpin loop structure. In this embodiment a BamHI restriction site is included in the spacer/loop. FIG. 11A also depicts the formation of the hairpin in the cytoplasm. FIG. 11B illustrates the dsRNA having the first and second RNA sub-sequences and spacer as present in the dsRP genome inside the capsid.

DETAILED DESCRIPTION OF THE INVENTION

The present invention provides compositions of double-stranded RNA particles (dsRPs) and methods of use. The dsRPs contain a double-stranded RNA molecule, which can be derived from a viral genome or portion of a genome, and has a sub-sequence of RNA that binds to a target sequence, for example a target RNA sequence of a pathogenic organism or an RNA sequence of a gene to be silenced (e.g., mRNA transcribed from the gene). The gene to be silenced can be a gene that is otherwise expressed or can be a regulatory element for such a gene, or a regulatory gene or a structural gene. When the dsRP is administered to an organism the RNA sub-sequence is liberated and is available to bind to the target sequence. The dsRPs of the invention can be derived from dsRNA viruses or retroviruses that are naturally found in a wide variety of yeast and fungal species and which propagate recombinant dsRNA molecules. The viruses and dsRPs of the invention can be introduced into an organism to be treated and utilized as a vaccine. In some embodiments the dsRPs can be derived from yeast killer and/or helper viruses or from a virus of the Totiviridae family. These mycoviruses are autonomously replicating, encapsidated dsRNA viruses that stably persist in the cytoplasm of a yeast or fungal cell. The helper virus (e.g. yeast L-A virus) contains a linear, non-segmented dsRNA genome (4.6 kb) comprising two overlapping ORFs: gag protein which encodes the major capsid protein (76 kDa) and pol, a multifunctional RNA-dependent RNA polymerase (RDRP, 100 kDa). In some embodiments (e.g., when the dsRP is derived from a virus of the family Totiviridae), the dsRP can also have a third ORF.

The invention enables the production and delivery of a recombinant dsRNA molecule that is packaged or encapsidated/encapsulated in a capsid or coat protein, and carries an RNA sub-sequence that binds to a target sequence of a pathogen. The dsRNA is packaged and amplified within a host cell (e.g., a yeast) using metabolic processes of the wild-type virus (e.g., L-A virus) and host cell. In some embodiments when the RNA sub-sequence binds to the target sequence of a pathogen, a critical function of the pathogen is disrupted. A critical function is one which must occur for the pathogen to sustainably infect the organism being treated. The critical function can be, for example, a reaction required for the pathogen to sustainably reproduce or propagate in the treated organism, or a reaction required in the tropism of the pathogen for the organism to be treated, or the transcription of a pathogen gene or other nucleic acid sequence necessary for such functions, or the expression of a critical gene or production of a critical protein. A critical gene is one that, if disrupted, prevents the pathogen from performing a critical function. A critical protein is one necessary for the pathogen to accomplish a critical function and necessary for the pathogen to sustainably infect the organism.

The dsRPs of the invention can contain a capsid protein (or shell) of a virus, and can be derived from a wild-type virus. By being "derived" from a wild-type virus is meant the capsid protein has at least 70% amino acid sequence identity or at least 80% amino acid sequence identity or at least 90% amino acid sequence identity or at least 95% amino acid sequence identity or at least 97% amino acid sequence identity at least 98% amino acid sequence identity or at least 99% amino acid sequence identity or 100% sequence identity with the wild-type capsid amino acid sequence. The capsid protein can have any of the aforementioned minimum amino acid sequence identities but also have less than 99% amino acid sequence identity or less than 95% amino acid sequence identity with the wild-type capsid protein sequence. Thus, the capsid protein of the dsRP of the invention can have from 90-99% or from 90-95% or from 95-100% or from 95-99% or from 95-98% or from 98-100% amino acid sequence identity compared to the wild-type capsid protein, as just some examples.

The dsRNA Molecule

The dsRPs of the invention can contain a dsRNA molecule that has a sub-sequence that binds to a target sequence. The dsRNA can be encapsidated or encapsulated in the dsRP. In some embodiments the dsRNA molecule is substantially a viral genome. By being "substantially" a viral genome is meant that the sequence contains sufficient genetic information for the dsRP to autonomously replicate within the host cell or treated organism, but is not a complete wild-type viral genome. In some embodiments the dsRNA molecule comprises a gag protein (or coat protein) that provides genetic instructions for making the major viral capsid protein. The dsRNA molecule can also contain one or more sequences for making an RNA polymerase, which can be an RNA-dependent RNA polymerase (RDRP). The dsRNA molecule can therefore encode a gag-pol fusion protein where gag encodes the major capsid protein and pol encodes a RNA-dependent RNA polymerase. In some embodiments the dsRNA molecule contains T7 ends to allow replication of the dsRP nucleic acid within the host cell. The host cell is the cell which produces the dsRPs of the invention. In one embodiment the host cell can be fed to the organism to be treated. In other embodiments the dsRNA can encode additional sequences such as CRISPR guide RNA, promoters where appropriate, and dominant negative transcripts.

In another embodiment the dsRP of the invention comprises two or more dsRNA molecules comprised within the proteinaceous coat of the dsRP. The two or more dsRNA molecules can each contain one or more RNA sub-sequences coding for RNA that will bind to one, two or more target sequences. Thus, in one embodiment the dsRP of the invention contains two dsRNA molecules, each of which codes for an RNA molecule that will bind to the same or separate target sequence(s).

RNA Sub-Sequence

In some embodiments the dsRNA molecule of the dsRP contains at least one RNA sub-sequence that binds to a target sequence. The at least one RNA sub-sequence is a portion of the dsRNA molecule, which is not found in the wild type virus and is heterologous to the wild-type virus. A heterologous sequence is a sequence not found in the wild-type or natural virus that the dsRP is derived from, or its complementary sequence. The heterologous sequence may be naturally found in another organism, and thus be a candidate for gene silencing. In one embodiment the at least one heterologous RNA sub-sequence binds to, or is complementary to, an mRNA sequence found in a pathogen or in a gene to be silenced (i.e., an RNA target sequence). The RNA sub-sequence can also be complementary to a heterologous gene to be silenced, or to a portion thereof. The RNA target sequence can be an RNA sequence from a genome of a viral or bacterial pathogen infecting the organism to be treated.

For example, if the dsRP of the invention is intended as a vaccine against a particular viral pathogen, the sub-sequence can be an RNA sequence that binds to an essential RNA sequence of the pathogen infecting the organism to be treated. In one embodiment the RNA sub-sequence is a sequence or contains a sequence that is antisense to the target sequence. In some embodiments the at least one RNA sub-sequence is inserted to the 3' side of the gag sequence.

The RNA sub-sequence can function in various ways. In one embodiment the RNA sub-sequence functions by base-pairing with complementary sequences of the target sequence (e.g., a mRNA target sequence) of a pathogen gene or gene to be silenced. This can result in gene silencing or inhibition via translational repression or target degradation, or gene knockdown. When a target sequence is degraded it can result in failure to produce the product of the gene. Silencing, repression, or inhibition of a gene can result in a beneficial effect, which can be any desired beneficial effect, for example protection from a pathogen or another desirable effect. As examples, a formulation of the invention can be used when silencing, repression, or inhibition of a gene results in improvement in a condition (e.g., a medical condition) or destruction of a pathogen. In some embodiments the gene is a gene that is being over-expressed or that produces a gene product that causes, results in, or worsens a condition. In these embodiments the invention can be used to reduce or eliminate expression of the gene.

In various embodiments gene expression can be inhibited by at least 10% or at least 30% or at least 50% or at least 75% or at least 90% or 100%, meaning that the expression of the gene is decreased by the said amount. Binding of the sub-sequence to the target sequence can also result in disruption of a critical function of a pathogen. "Disruption" of a critical function means the function is prevented from occurring to the extent necessary for the pathogen to sustain itself within the organism to be treated. Administration of the dsRP of the invention to an organism to be treated therefore can provide protection to the organism against a disease. If the pathogen is unable to perform or have performed the critical function the pathogen is unable to sustainably infect the organism. Signs of disease may therefore disappear or not be manifested in the treated organism when the invention is used as a vaccine. The target sequence can be a sequence of RNA utilized by the pathogen to perform an essential function. In other embodiments the target sequence is a sequence of the organism to be treated coding a gene to be repressed or silenced, or a regulatory sequence therefor.

In one embodiment the dsRP is derived from the dsRNA helper virus L-A, which infects *S. cerevisiae*, and the dsRNA molecule encodes substantially the genome of the L-A virus. L-A has a linear, non-segmented dsRNA genome having two overlapping ORFs—gag (76 kb) and pol. Gag encodes the major capsid protein of the virus and pol encodes the RNA-dependent RNA polymerase of the virus. The size of the native genome is 4.6 kb. Within the yeast organism, pol is expressed as a Gag/pol fusion protein by a −1 ribosomal frame-shift event and Gag self-assembles into the capsid. In other embodiments the dsRP can be derived from a bacteriophage (e.g., bacteriophage ϕ6, bacteriophage T7), an alphavirus, L-BC helper virus, L-A-lus, M2, M28, M-lus, or from the M1 killer mycovirus. The dsRP can encode a dsRNA molecule derived from the genome of the virus it is derived from. In some embodiments the dsRNA of the dsRP comprises the entire wild-type or natural sequence of the virus it is derived from, but contains the additional at least one sub-sequence of RNA as described herein. The at least one RNA sub-sequence can be inserted at an appropriate locus in the wild-type or natural genome. In one embodiment when the dsRP of the invention is derived from L-A, the at least one RNA sub-sequence is inserted 3' to gag. In one embodiment a 5' untranslated region is also included. In a specific embodiment the dsRP genome comprises sequences as follows: 5'UTR—at least one RNA sub-sequence-IRE-VBS-3' UTR, where the IRE is the internal replication enhancer and VBS is the viral particle binding site.

In particular embodiments the target sequence can be any one or more of the viral nucleotide sequences found in SEQ ID NOs: 1-103 or any sub-portion thereof or any RNA coded by the DNA sequences found in SEQ ID NOs 1-103 or any sub-portion of any of them. The target sequence can also be an RNA sequence that codes for a peptide sequence found in any one or more of SEQ ID NOs: 1-103, or a sub-portion of any of them. SEQ ID NO: 1 is the gag-pol fusion protein and SEQ ID NOs: 2-103 include structural and envelope proteins of WSSV virus, with the even numbers being peptide sequences and the odd numbers being nucleotide sequences. In some embodiments the sub-portion of such sequences will have the same number of nucleotides as the sub-sequence of RNA that binds to the sub-portion or RNA target sequence. In some embodiments the target sequence is an RNA sequence coded for by the genome of a peneid shrimp, a salmonid fish, or an animal of the genus *Sus* (pigs) within the Suidae family, cattle, horses, but the target sequence can also be that of any mammal, even a human.

In another embodiment the dsRNA molecule contains a sub-sequence of RNA and a second sequence complementary to the RNA sub-sequence. The RNA sub-sequence and complementary sequence are separated by a spacer sequence. The RNA sub-sequence and the complementary sequence are the reverse complement of one another allowing the molecule in the single-stranded form to form a hairpin structure because the sub-sequence and complementary sequence are the reverse compliment of one another. The molecule thereby can form a dsRNA structure. When extruded into the host cell cytoplasm as ssRNA the molecule forms the hairpin structure, thus taking the form of dsRNA (FIG. 11). Since it is dsRNA it is recognized by cellular machinery and processed into ssRNA, thus producing an RNA sub-sequence that can bind to the target sequence. Thus two copies of RNA that bind to the target are generated. In this manner the number of sub-sequences available for binding to a target sequence are amplified. The hairpin structure can contain any appropriate number of nucleotides, which will be bound in the dsRNA hairpin. In various embodiments the hairpin structure can contain any number of nucleotides per single strand involved in the dsRNA as stated herein for the sub-sequence. The spacer sequence can be any appropriate number of nucleotides and, in various embodiments, has 4 or 5 or 6 or 7 or 8 or 9 or 10 or 11 or 12 nucleotides, or 3-8 or 3-10 or 4-8 or 4-10 or 5-8 or 5-10 or 6-8 or 6-10 or 6-15 or 8-15 or 6-20 or 8-20 or 6-25 or 8-25 or 6-30 or 8-30 or 6-40 or 8-40 or 8-50 or 8-70 or 8-100 nucleotides.

The dsRPs of the invention can be derived from a naturally occurring virus (e.g. an RNA virus or retrovirus), meaning that the dsRNA molecule within the dsRP is substantially the same as the wild type genome but has been modified to include desirable characteristics, for example to include a recombinant RNA sub-sequence that binds to a target sequence. In different embodiments the dsRPs of the invention have at least at least 50% or at least 60% or at least 70% or at least 80% or at least 90% or at least 95% or 80-99% or 90-99% or 95-99% or 97-99% or 98-99% sequence identity with the sequence of the wild type genome. The dsRPs of the invention can retain in the recombinant genome the wild-type virus' ability to replicate and propagate and self-assemble in a host organism through the virus' natural processes. "Derived from" can also indicate that the RNA sequence of the dsRP contains an RNA sub-sequence that is not contained by the wild-type RNA sequence. In one embodiment the dsRPs of the invention have a dsRNA molecule encapsidated or encapsulated by the capsid, or the dsRNA molecule is otherwise closely associated with the capsid protein. The dsRNA can be covalently bound to the capsid protein. The dsRNA molecule can be at least 100 bp or at least 150 bp or at least 200 bp or at least 500 bp or at least 1 kb or at least 2 kb or at least 3 kb or at least 4 kb or at least 5 kb or at least 6 kb or at least 7 kb or at least 8 kb in size, or can be 100 bp-8 kb or 500 bp-8 kb or 500 bp-7 kb or 1-7 kb or 1-8 kb in size.

"Derived from" a wild-type virus can also mean the dsRNA molecule of the dsRP of the invention can have at least 80% or at least 90% or at least 95% or at least 97% or at least 98% or at least 99% or 100% or 80-99% or 90-100% or 95-99% or 95-100% or 97-99% or 97-100% or 98-99% sequence identity with the wild-type RNA genome not counting the sub-sequence of RNA that binds to a target sequence. In one embodiment the dsRP of the invention can have the same capsid sequence (100% sequence identity of the capsid sequence) as the wild-type virus it is derived from but have an additional sequence not encoded by the wild-type virus. The additional sequence can be part of the fusion gene. In one embodiment, when the virus or dsRP is derived from wild-type L-A virus, the additional sequence can be placed in between the RNA sequences for gag and pol.

Possible Mechanism of Action

The at least one sub-sequence of RNA of the invention can function by providing RNA interference (RNAi). Upon uptake of the dsRP of the invention by a treated organism, the recombinant dsRNA is provided by the dsRP and can be processed to produce one or more RNA sub-sequence(s), which can be one or more molecules of micro RNA (miRNA) or small interfering RNA (siRNA), by the dsRNA molecule and/or organism's metabolic processes. In some embodiments the dsRNA can be cleaved by the metabolic processes and machinery of the organism to be treated to produce one or more smaller sub-sequences of dsRNA that bind to one or more target sequences. Thus, a larger sub-sequence can be divided into smaller sub-sequences. These smaller sub-sequences can be siRNA or miRNA. The dsRNA may thus be cleaved into shorter pieces that are complementary to one or more specific target sequences by, for example, an RNase III enzyme (e.g., Dicer), which can cause translational repression at the ribosome. The cleaved, smaller sequences of RNA can bind to the target sequence, or might become single-stranded RNA, and it is believed that, upon binding to a target sequence (e.g., an mRNA), the RNA (e.g., siRNA or miRNA) will trigger degradation of the target sequence or failure to translate it, resulting in silencing or suppression of the gene or other target of interest. In other embodiments the sub-sequence exists as RNA that has folded back on itself to form a short hairpin. In still other embodiments the target sequence is DNA and binding of the smaller, cleaved RNA represses or prevents expression of the gene.

Without wanting to be bound by any specific mechanisms or theories it is believed that in at least one embodiment the invention functions by using the RNAi pathway. The RNAi pathway is a cellular pathway that results in gene silencing in a sequence-specific manner. The RNAi pathway can be initiated by the enzyme Dicer, which cleaves dsRNA into shorter siRNA, which can be about 20 nucleotides long or 20-25 nucleotides long. The siRNA can then subsequently pair with a complementary sequence in an mRNA causing the elimination of the mRNA and silencing of the gene.

In some embodiments the sub-sequence of RNA has at least 5 nucleotides or at least 10 nucleotides or at least 15 nucleotides or at least 20 nucleotides or 30 or less nucleotides per single strand, or 25 or less nucleotides, or 22 or less nucleotides or 20 or less nucleotides or 18 or less nucleotides or 15 or less nucleotides 5-30 nucleotides or 5-50 nucleotides or 10-20 nucleotides or 10-30 nucleotides or 10-40 nucleotides or 10-50 nucleotides or 15-20 nucleotides or 15-30 nucleotides or 15-40 nucleotides or 15-50 nucleotides or 20-30 nucleotides or 20-25 nucleotides, or 21-24 nucleotides or 22-24 nucleotides or 20 or 21 or 22 or 23 or 24 or 25 or 26 or 27 or 28 or 29 or 30 nucleotides per single strand. The sub-sequence can also have at least 50 nucleotides or at least 100 nucleotides or at least 200 nucleotides or at least 300 nucleotides or at least 500 nucleotides or at least 1000 nucleotides per single strand. The RNA sub-sequence can be part of a fusion gene (e.g. gag-x, where x is a non-wild type sequence). In some embodiments the RNA sub-sequence contains multiple sequences that, when cleaved, can bind to multiple target sequences. The RNA sequences can include multiple sub-sequences and the target sequence can be any RNA or DNA sequence that can be identified and that is wished to be suppressed as described herein. The RNA sub-sequence can thus be cleaved in the organism to be treated into multiple siRNAs or miRNAs, which can each bind to a distinct target sequence. Thus, in some embodiments the sub-sequence of RNA has less than 9 kb or less than 8 kb or less than 7 kb or less than 6 kb or less than 5 kb or less than 4 kb per strand of RNA. In still more embodiments the sub-sequence of RNA can have from 100 bp-1 kb or from 1-2 kb or from 1-4 kb or from 1-8 kb or from 2-8 kb or from 4-6 kb or from 4-8 kb or from 4-9 kb. The siRNA or miRNA can have a phosphylated 5'end and a hydroxylated 3' end with one or two or three overhanging nucleotides.

Target Sequence

In one embodiment the target sequence is an RNA sequence of a pathogen. For example, the target sequence can be an mRNA sequence coding for an important or critical protein of the pathogen. The target sequence can also be an mRNA of a gene in the organism to be treated that it is desirable to silence. In some embodiments the target sequence is an RNA sequence coded for by the genome of a pathogen. In some embodiments the target sequence is unique to a pathogen or class of pathogens, or is coded for only by the genome of a pathogen or class of pathogens. In various embodiments the class of pathogen is any described herein. The target sequence can also be a sequence unique to a gene to be silenced. In some embodiments the target sequence can also be a regulatory sequence, either a DNA sequence or RNA sequence, that regulates expression of a gene. By unique is meant that the sequence is found only in the pathogen genome in the context or within the environment of the treatment. In other embodiments the target sequence can be an rRNA sequence. The target sequence can be any RNA sequence that, when the RNA sub-sequence binds to it, the translation or expression of the gene is blocked or changed. The change can be the diminishing of the expression of a gene. In some embodiments the target sequence can also be a DNA sequence on a gene to be silenced, or a regulatory DNA sequence for a gene to be silenced. The target sequence can also be an mRNA of a critical protein.

Production of dsRP

Once the dsRP of the invention has been presented to the host cell (or a plasmid encoding the dsRP of the invention), the dsRP will be produced within the host cell. The dsRP of the invention is therefore self-sustaining within the host cell and is propagated within the host cell. In different embodiments the dsRP can be either harvested from the host cell, or the host cells can be fed to the organism to be treated. The host cell can be any suitable host cell such as, for example, a eukaryotic cell, a mammalian cell, a fungal cell, or a yeast cell, for example from the genus *Saccharomyces* (e.g., *cerevisiae*) or *Zygosaccharomyces*, or *Candida*. The host cell can propagate a recombinant dsRP after a recombinant dsRNA molecule of the invention or a DNA molecule encoding a dsRP of the invention is presented to and taken up by the host cell.

The dsRP of the invention an also be produced by presenting to a host cell a plasmid or other DNA molecule encoding a dsRP of the invention. The plasmid or DNA molecule is then transformed into the host cell and the host cell begins producing the dsRP of the invention.

Vaccines and Formulations

The invention also provides a formulation containing a dsRP of the invention. The formulations of the invention can be useful as a vaccine or treatment. The formulations can contain a dsRP of the invention provided in a pharmaceutically acceptable carrier. The formulations can be administered to treat a disease or silence a gene, and examples of animals to be treated and diseases that can be prevented or cured in the treated animals are described herein. Depending on the animal to be treated the formulations can be administered either by providing the dsRP with the feed of the animal or, in the case of salmon or shrimp or other aquatic animals, by providing it in the water in which the animal lives, or by direct injection of the formulation into the organism to be treated. The dsRP can also be provided within the host cell (e.g., yeast cells) where the dsRP is produced, again either with the animal's feed or by providing it in the water in which the animal lives. The formulations of the invention can therefore confer an "immunity" and function as a "vaccine" in the sense that the formulations can be administered to animals as a preventive measure and the treated animals will not be infected or killed by a pathogen that the formulation is directed to. Infected can mean that, although the animal may be exposed to the pathogen it will not exhibit the usual symptoms of such infection, or its growth or health will not be detrimentally affected by the pathogen. The formulations can be pre-administered to prevent infections by the relevant pathogen from occurring. The immunity conferred can last at least 2 weeks or at least 4 weeks or at least 6 weeks or at least 9 weeks or at least 12 weeks or at least 6 months or at least 1 year post-vaccination. The immunity can also be a permanent immunity that the treated animal has for the duration of its life. The formulations or vaccines of the invention can be provided in a pharmaceutically acceptable carrier. In one embodiment the pharmaceutically acceptable carrier is phosphate buffered saline, but it can be any carrier that preserves the formulations for an acceptable period of time without causing the formulations to lose efficacy. The pharmaceutically acceptable carrier can also contain complexing agents, e.g., polycations.

The formulation of the invention can also contain host cells of the invention that contain and/or produce a dsRP of the invention. The host cells can be whole cells or ruptured cells, or portions thereof. In one embodiment the dsRP of the invention is provided in transformed host cells, which are provided in the feed of the animal to be treated. The invention therefore provides methods of treating an animal disease or silencing a gene by administering to an animal to be treated a formulation of the invention. The formulation can be administered by any manner described herein. The dsRP of the invention and host cells containing a dsRP of the invention are also useful in the manufacture of a medicament for the treatment of diseases or for silencing genes, as described herein.

The formulations of the invention can be utilized as a vaccine to prevent a disease or disorder from occurring or can be administered after a disease or disorder has occurred. The dsRPs of the invention can thus be employed within the treated organism to attenuate or restrict cellular tropism of replication-competent viral or bacterial pathogens.

Harvest

Another step in the methods is to harvest the dsRP particle from the host cell. Harvesting can be done by methods known in the art for harvesting particles from host cells. To increase dsRP yield, production can be stimulated by challenge with a non-killer strain, or by including appropriately placed wild-type constitutive/inducible promoters in the dsRNA molecule for high virus production. Host cells can also be ruptured by vortexing. The dsRP can then be conveniently harvested, purified if desired, and formulated for dosing. The physical harvesting of the dsRPs of the invention can be done by, for example, centrifugation followed by washing and re-suspension in appropriate buffer.

Induction of wild type dsRNA virus may be advantageous for the production of recombinant virus. But it is believed by the inventors that several DNA driven components (e.g., gag &/or RDRP) and recombinant ssRNA provided in trans and encoded on a DNA molecule for transcription as non-coding RNA can provide the ability to form a dsRP assembled de novo, that encapsidates RNA with specific attachment or packaging sequences. This strategy is therefore advantageous in vaccine production. Yeast cells and total nucleic acid can also simply be harvested and formulated for the specific application. Upon harvest of the dsRP of the invention and formulation as a vaccine or treatment, the dsRPs can be introduced into the organism to be treated to provide the protection.

Figure 2:
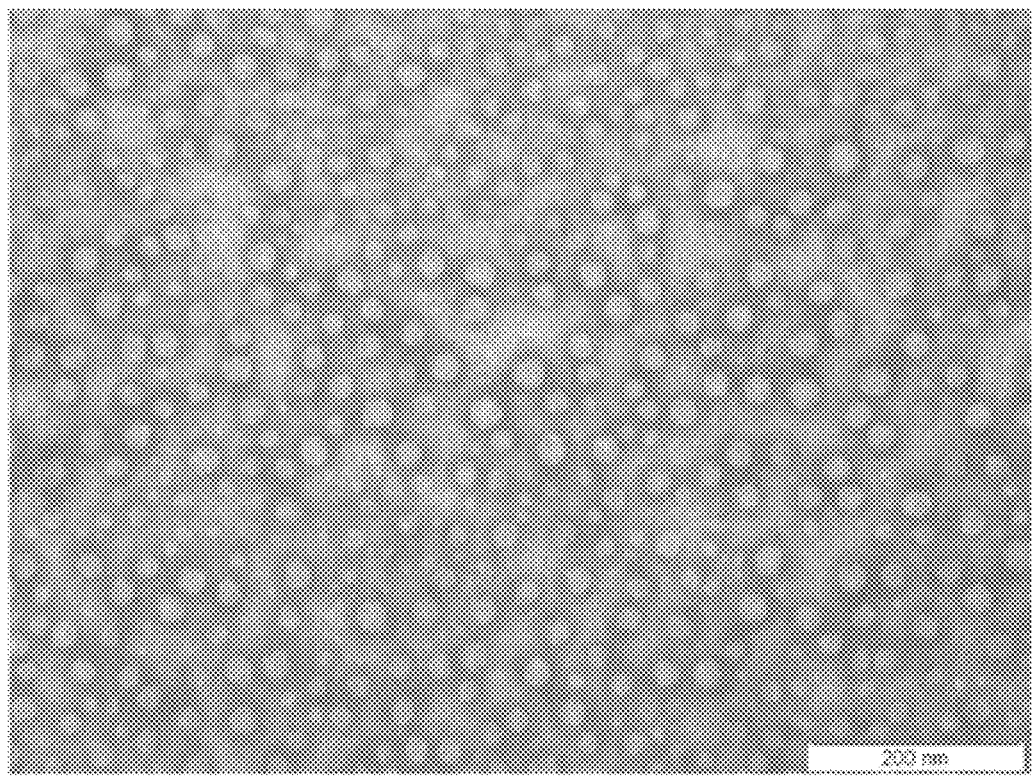

One key barrier to getting efficient uptake of dsRPs and subsequent protection by RNAi is the technical inability to reliably produce dsRPs that are less than 100 nm in diameter. While the use of dsRPs of greater than 100 nm in diameter is useful when the organism to be treated can be conveniently manipulated for needle injection, the targeting of protection to smaller organisms requires a dsRP that can be taken up by ingestion or passive absorption across membranes, which means dsRPs of a size appropriate for this manner of providing dsRP to the organism. In some embodiments the dsRPs of the invention comprise one or two dsRNA molecules encapsulated in a capsid, where the capsid is a protein shell comprised of oligomeric structural subunits. The capsid represents the diameter of the dsRP. In one embodiment the dsRPs of the present invention have a diameter of less than 100 nm. Using transmission electron microscopy (TEM) it has been determined that the present invention produces dsRPs of from about 40 to about 80 nm in diameter (FIG. 2). In various embodiments the dsRPs of the invention have a diameter of less than 90 nm or less than 80 nm or less than 70 nm or less than 60 nm or less than 50 nm, or from 40-90 nm or from 48-80 nm or from 40-70 nm or from 40-60 nm or from 50-80 nm or 30-50 nm or 35-45 nm or about 35 nm or about 40 nm or about 45 nm or about 50 nm.

The dsRPs of the invention can be any suitable dsRP particle that can be engineered according to the present invention. In various embodiments the dsRP is derived from a virus of the family Totiviridae, or from any of the families Reoviridae, Partiviridae, Chrysoviridae, or Alternaviridae. In one embodiment the dsRP is the mycovirus helper virus L-A. In other embodiments the dsRP is bacteriophage φ6, or a rotavirus, or any dsRNA virus or retrovirus.

The Pathogen

The pathogen can be any organism that causes a disease or disorder and for which a target sequence can be determined. The pathogen can be one that has infected an organism to be treated or that is likely to infect an organism to be treated. In different embodiments the pathogen can be a virus, a bacteria, a protist, a fungi, or any pathogen that can have a critical function disrupted by binding of RNA to a target sequence. In various embodiments the pathogen can be a virus that causes a disease in an aquatic organism, such as white spot syndrome (WSS) in penaeid shrimp, or a virus that causes a disease in a domestic animal, such as an animal of the genus *Sus*, or a virus that causes an infection in fish, such as Infectious Pancreatic Necrosis (IPN) in salmonid fish. In one embodiment the pathogen is infectious pancreatic necrosis virus, or a member of the Birnaviridae family of viruses. In one embodiment the pathogen is one or more viruses of the Whitespot Syndrome Baculovirus (WSSV) complex. In other exemplary embodiments the virus can be an influenza virus, a cytomegalovirus, a porcine reproductive and respiratory syndrome virus (PRRSV), a human papilloma virus, a herpes simplex virus, an Ebola virus, a Marburg or hemorrhagic fever virus, a poxviridae virus, a rhinovirus, and a viral encephalitis virus. The organism to be treated can be any organism that is or that can be infected by the pathogen. Non-exclusive examples of organisms that can be treated include penaeid shrimp, salmonid fish, or mammals such as cattle, hogs (or an animal of the genus *Sus*), horses, or any domestic animal. But any mammal can be treated according to the invention, including humans.

Any sequence that causes a disruption in the pathogen when an RNA molecule binds to it can be used as the target sequence. Some sequences that can be utilized as the target are RNA sequences that code for structural or envelope proteins. Examples of structural and envelope proteins for the White Spot syndrome virus include: P5MICT165251 (VP664), P5MICG165251 (VP664), P5MICT164891 (VP180), P5MICG164891 (VP180), P5MICT165161 (VP136A), P5MICG165161 (VP136A), P5MICT165356 (VP136B), P5MICG165356 (VP136B), P5MICT164892, P5MICG164892, P5MICT164925 (VP110), P5MICG164925 (VP110), P5MICT165333 (VP95), P5MICG165333 (VP95), P5MICT165223 (VP75), P5MICG165223 (VP75), P5MICT165110 (VP73), P5MICG165110 (VP73), P5MICT165216 (VP60A), P5MICG165216 (VP60A), P5MICT165306 (VP60B), P5MICG165306 (VP60B), P5MICT165417 (VP55), P5MICG165417 (VP55), P5MICT164901 (VP53A), P5MICG164901 (VP53A), P5MICT165005 (VP53B), P5MICG165005 (VP53B), P5MICT165159 (VP53C), P5MICG165159 (VP53C), P5MICT165128 (VP51A), P5MICG165128 (VP51A), P5MICT165146 (VP51B), P5MICG165146 (VP51B), P5MICT165120, PtMICG165120, P5MICT165121, P5MICT165124, P5MICG165124 sequence_region_id=4491 start=130290 stop=129406 length=885, P5MICT165127 (VP41A), P5MICG165127 (VP41A), P5MICT165132 (VP41B), P5MICG165132 (VP41B), P5MICT165197 (VP39A), P5MICG165197 (VP39A), P5MICT165230 (VP39B), P5MICG165230 (VP39B), P5MICT165149 (VP38A), P5MICG165149 (VP38A), P5MICT165281 (VP38B), P5MICG165281 (VP38B), P5MICT164967 (VP36A), P5MICG164967 (VP36A), P5MICT165142, P5MICG165142, P5MICT165144 (VP36), P5MICG165144 (VP36B), P5MICT165199 (VP51C), P5MICG165199 (VP51C), P5MICT165202 (VP26), P5MICT165231 (VP31), P5MICT165277 (VP12B), P5MICT165305 (VP19), P5MICG165305 (VP19), P5MICT165312 (VP28), P5MICT165104 (VP15), P5MICG165104 (VP15), P5MICT165174 (VP13A), P5MICG165174 (VP13A), P5MICT165212 (VP13B), P5MICG165212 (VP13B), P5MICT164899 (VP12A), P5MICG164899 (VP12A), P5MICT165229 (VP11), P5MICG165229 (VP11), P5MICT165370, P5MICG165370 sequence_region_id=4491 start=276737 stop=275208 length=1530, P5MICT165384 (VP35), P5MICG165384 (VP35), P5MICT165088 (VP32), P5MICG165088 (VP32), P5MICT165388, P5MICG165388 sequence_region_id=4491 start=285774 stop=284077 length=1698, P5MICT165399, P5MICT165458, P5MICT165481 (VP24), P5MICG165481 (VP24), P5MICT165194 (VP22), P5MICG165194 (VP22), P5MICT165730, P5MICG165730 sequence_region_id=4492 start=173709 stop=175211 length=1503, P5MICT165868, P5MICT165896. One or more RNAs coding for any one or more of these proteins or portions thereof can be utilized as the RNA target.

Methods of Producing a dsRNA Virus or dsRP

The invention also provides methods of producing a dsRP of the invention. One step of the methods involves the presentation of a double-stranded or single-stranded RNA molecule to a host cell. The host cell can be any cell that can produce the dsRPs. Examples of host cells include, but are not limited to, yeast cells such as those of the genus *Saccharomyces* or *Candida*, or a suitable mammalian cell, bacterial cell, or insect cell.

The presentation of a dsRNA or ssRNA molecule of the invention can be performed in any suitable way such as, for example, by presenting an RNA molecule directly to the host cell as "naked" or unmodified single-stranded or double-stranded RNA. The RNA molecule can be transfected into a yeast, bacterial, or mammalian host cell by any suitable method, for example by electroporation, exposure of the host cell to calcium phosphate, or by the production of liposomes that fuse with the cell membrane and deposit the viral sequence inside. It can also be performed by a specific mechanism of direct introduction of dsRNA from killer viruses or heterologous dsRNA into the host cell. This step can be optimized using a reporter system, such as red fluorescent protein (RFP), or by targeting a specific constitutive gene transcript within the host cell genome. This can be done by using a target with an obvious phenotype or by monitoring by quantitative reverse transcriptase PCR (RT-PCR).

In some embodiments the RNA molecule can be introduced into the host cell in the form of a DNA molecule (e.g., a plasmid) that encodes the RNA molecule. The DNA molecule can contain a sequence coding for the RNA molecule of a dsRP of the invention. The DNA molecule can code for an entire genome of the dsRP, or a portion thereof. The DNA molecule can further code for the at least one sub-sequence of RNA that produces the RNA product that binds to the RNA target sequence of the dsRP. The DNA sequence can also code for gag protein or gag-pol protein, and as well as any necessary or desirable promoters or other sequences supporting the expression and purpose of the molecule. The DNA molecule can be a linear DNA, a circular DNA, a plasmid, a yeast artificial chromosome, or may take another form convenient for the specific application. In any embodiment the DNA molecule can further comprise T7 ends for producing concatamers and hairpin structures, thus allowing for propagation of the virus or dsRP sequence in the yeast host cell. The DNA molecule can be transfected into the host cell, and then using the host cellular machinery, transcribed and thus provide the dsRNA molecule having the at least one sub-sequence of RNA to the host cell. The dsRNA can then be packaged in the same manner that a wild-type virus would be, using the host cell's metabolic processes and machinery. The DNA molecule can be transfected into the host cells by known methods, as described above. A plasmid of the invention can have any sequences described herein, including by not limited to, the at least one RNA sub-sequences and any regulatory, structural, or other sequences described herein that are desirable or necessary for dsRP production or other purposes described herein.

In some embodiments the in vitro activation of synthetic RNA can involve the use of additional helper proteins, or the "priming" of Saccharomyces cerevisiae before introduction of the dsRNA molecule. In one embodiment adding a viral or synthetic dsRNA molecule to the opened empty particles, with the host factor(s) and high concentrations of polyethylene glycol, results in the conservative synthesis of viral (+) ssRNA, which is specific for viral templates, but the recognized cis-acting signals may not be optimized. However the synthesis of the (+) strands into dsRNA occurs in vitro.

Another step in the methods is therefore to provide conditions so that the host cell takes up the dsRNA molecule or host cell plasmid encoding for the dsRNA molecule. Components of the host cell will then participate in the production of the dsRP. By "participate" is meant that at least one step in the production of the dsRP will be performed in conjunction with metabolic components, elements, or cellular "machinery" of the host cell. The "participation" also means the production of the dsRP would not occur without presence and action of the host cell's metabolic components or the environment provided by the host cell. In one embodiment the metabolic component of the host cell includes Mak3p, which performs acetylation of Gag protein (the major capsid protein).

Example 1—Host Cell Selection

Various Saccharomyces strains were obtained from ATCC as potential hosts or background to genomes to look at a dsRNA production system. Table 1 highlights these strains and their viral phenotypes. These strains were characterized for virus or dsRP and dsRNA production by western blot and RNA isolation from prepared capsids. Agarose gel electrophoresis showed the predominant 4.6 kb dsRNA in several strains (FIG. 1), which was confirmed by western blot analysis. Cells were normalized by cell count as a qualitative determination of capsid (76 kDa) using a specific IgG for conserved gag epitopes. The collection demonstrated a range of viral phenotypes or traits that are potentially beneficial for recombinant dsRNA and dsRP production.

TABLE 1

| Sacch. Cerevisiae Strain | Genotype |
| --- | --- |
| CEN.PK2-1c | MATa; ura3-52; trp1-289; leu2-3, 112; his3Δ 1; MAL2-8$^C$; SUC2 |
| ATCC 44827 | MATa/MATα ade1/+ +/ade2 +/his1 |
| ATCC 42017 | |
| ATCC 42016 | MATa ade2-1 his his4-864 [KIL-S3] |
| ATCC 42950 | MATa ade- [KIL-o] |
| ATCC 46307 | MATα ura1 trp1 MEL1 GAL [KIL-k] |
| ATCC 208718 | high levels of dsRNA gal |
| ATCC 46304 | [KIL-n] |
| ATCC 42015 | MATa ade his |
| ATCC 46305 | MATα ade2-5 [KIL-k] |
| ATCC 208717 | MATa ade2-1 his4-864 [KIL-S3] |

The deposited culture collection demonstrated a range of viral phenotypes or traits that could be beneficial for recombinant dsRNA or viral or dsRP production. Capsid purification was performed based on standard protocols. Capsid isolation was improved by using a reporter system.

A series of classically derived strains was also isolated that are able to provide the necessary host cytoplasmic factors essential for efficient dsRP assembly and packaging. Transcriptomics analysis of these strains revealed the necessary genes for this phenomenon.

Analysis of Wild-Type Yeast dsRP

Whole cells producing wild type dsRNA capsid were grown and harvested. A Saccharomyces cerevisiae colony was inoculated into 10 ml of YPD media (2.0% Peptone, 1.0% yeast nitrogen base, 2.0% glucose), cultures were grown up at 30° C. at 225 rpm overnight. Cell pellets were harvested with approximately $1\times10^8$ cells per ml on a 0.45 filter apparatus. The filter was washed with 10 ml of 0.1 M cacodylate, pH 6.8 and cells washed off and resuspended in 10 ml of 0.1 M cacodylate buffer containing 2.5% glutaraldehyde (fixative) and fixed at room temperature 1 hour. Cells were then fixed overnight at 4° C. The fixed cells were then washed twice in 50 mM potassium phosphate buffer pH 7.5 and finally resuspended in 2 ml potassium phosphate buffer containing 0.25 mg ml$^{-1}$ of ZYMOLASE® (a yeast lytic enzyme) and incubated for 40 min at 37° C. The resulting spheroplasts were washed twice with ice cold 0.1 M cacodylate buffer, resuspended in 1.5 ml fixative, and retained at 4° C.

For capsid preparation, a Saccharomyces cerevisiae colony was inoculated into 10 ml of YPD (2.0% Peptone, 1.0% Yeast Nitrogen Base, and 2.0% Glucose) or SD-Uracil media and grown up at 30° C. at 225 rpm overnight. The culture was then expanded into 400 ml of respective media and grown up at 30° C. at 225 rpm overnight. Cells were harvested by 10 min centrifugation at 5,000 g (4° C.), washed in pre-chilled $H_2O$, then washed in 1 M sorbitol, and finally resuspended in 50 ml cold PBSES (150 mM NaCl, 10 mM $Na_2HPO_4$ pH 7.4, 10 mM EDTA, 1 M sorbitol). Subsequently, 2-mercaptoethanol (1:2,000 and 2.5 mg ZYMOLASE 20T® were added and incubated at 30° C. for 1.5 h incubation at 120 rpm.

Spheroplasts were collected by 15 min centrifugation at 5000 g (4° C.) and washed in cold PBSES. Cells were resuspended in 10 ml PBSE (150 mM NaCl, 10 mM $Na_2HPO_4$ pH 7.4, 10 mM EDTA) and disrupted by vortexing seven times for 1 min (with 1 min breaks in between to cool samples on ice) in the presence of 12 g glass beads (0.45-0.55 mm). The resulting extracts were supplemented with 10 ml PBSE and centrifuged at 10,000 g for 1 h (4° C.) to sediment glass beads and cell debris. The supernatant was adjusted with PBSE to 23 ml and then layered onto a cushion of 15 ml 45% sucrose. During ultracentrifugation at 69,260 g overnight (4° C.) only structures of high molecular weight pass the cushion and form a pellet. Subsequently, the cushion pellet was resuspended in 1 ml PBSE and layered onto a linear density gradient (38 ml) of 20-70% sucrose. Upon further ultracentrifugation at 76,740 g overnight (4° C.) the gradient was fractionated into 18-20 fractions (each 2 ml) while the gradient pellet was resuspended in 2 ml PBSE. Aliquots of each fraction were subjected to SDS-PAGE followed by western analysis or Coomassie blue staining. Finally, the dsRP pellet was resuspended in 100-500 ml PBSE and stored at 4° C.

Prior to TEM processing the samples were washed twice in ice cold 0.1 M cacodylate buffer, resuspended in 1.5 ml of cold 2% $OsO_4$ (Osmium tetroxide), in 0.1 M cacodylate buffer, and incubated for 1 hour on ice in a hood. Samples were rinsed 3× with $H_2O$. 1.5 ml of 2% uranyl acetate (UrAc) aq. was added, and sample was incubated at room temp for 1 hour, then rinsed 2× with $H_2O$. Surplus sample was completely removed as UrAc is slightly radioactive. The sample was dehydrated by washing with 50%, 70%, 90% and 100% EtOH, then rinsed 1× in 100% acetone and then 50% acetone/50% DURCUPAN® was added to each tube and incubated 2 hours. Then DURCUPAN® was changed to 100% and the tubes incubated overnight. DURCUPAN® 2× was also used over the next day. The tubes were baked at 60° C. for 24 hr, and sections stained with lead citrate and uranyl acetate (UrAc).

Example 2—Synthesis and Assembly of a Recombinant dsRNA Particle

This example illustrates the synthesis of capsids containing red fluorescent protein. This was carried out by the construction of a gag-RFP fusion sequence (SEQ ID NO: 1). A series of plasmid vectors were constructed encoding the gag protein and a 3' fusion to a commercially available RFP (TagRFP, EVROGEN®, Inc.). The fusion sequence was cloned into a CEN-ARS plasmid and a 2 µM shuttle vector, with either a KanMX marker cassette for gentamycin resistance or a Uracil (Ura3) cassette for auxotrophic complementation.

Figures 3A, 3B:
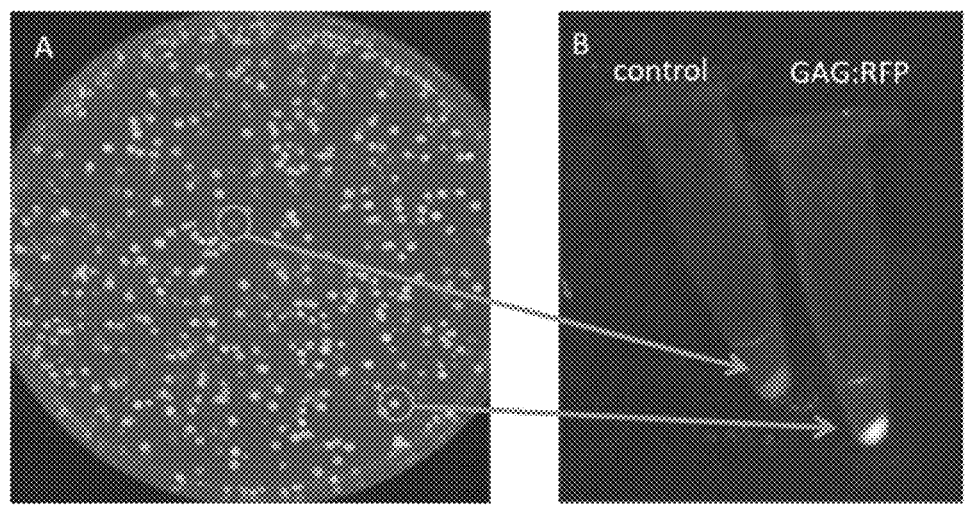
Figure 4:
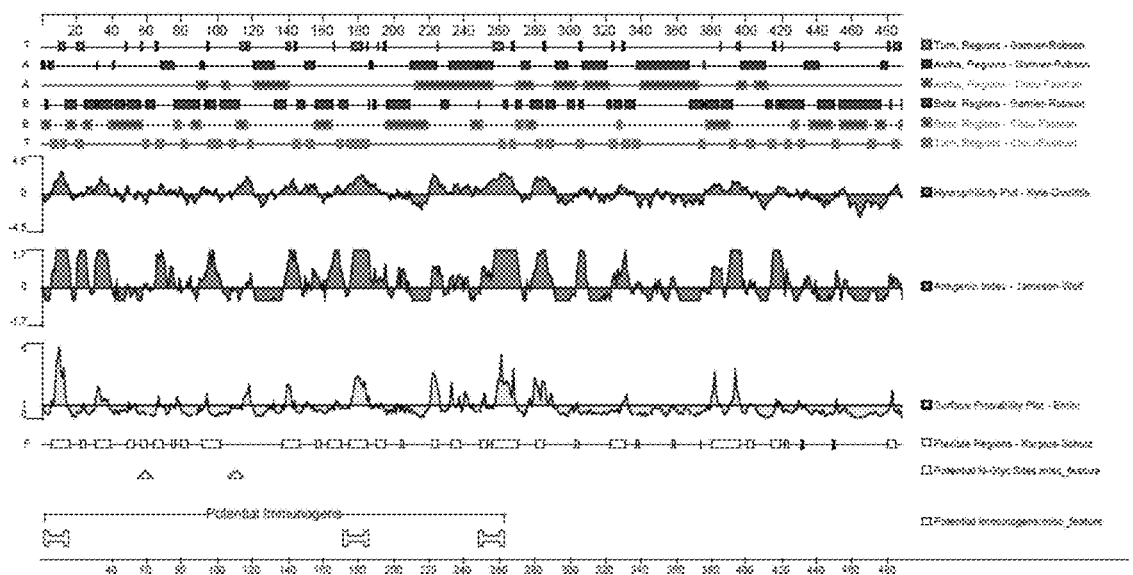

The resultant clones had the characteristic red fluorescent colony phenotype as illustrated in FIG. 3. Colonies were cultured for production of recombinant dsRP and capsid isolation on the sucrose gradient, as detailed above. The production of recombinant capsid was validated by polyclonal IgG raised against specific peptides. The selection of peptides was based on several epitope prediction algorithms, the results of which are shown in FIG. 4.

Figure 5:
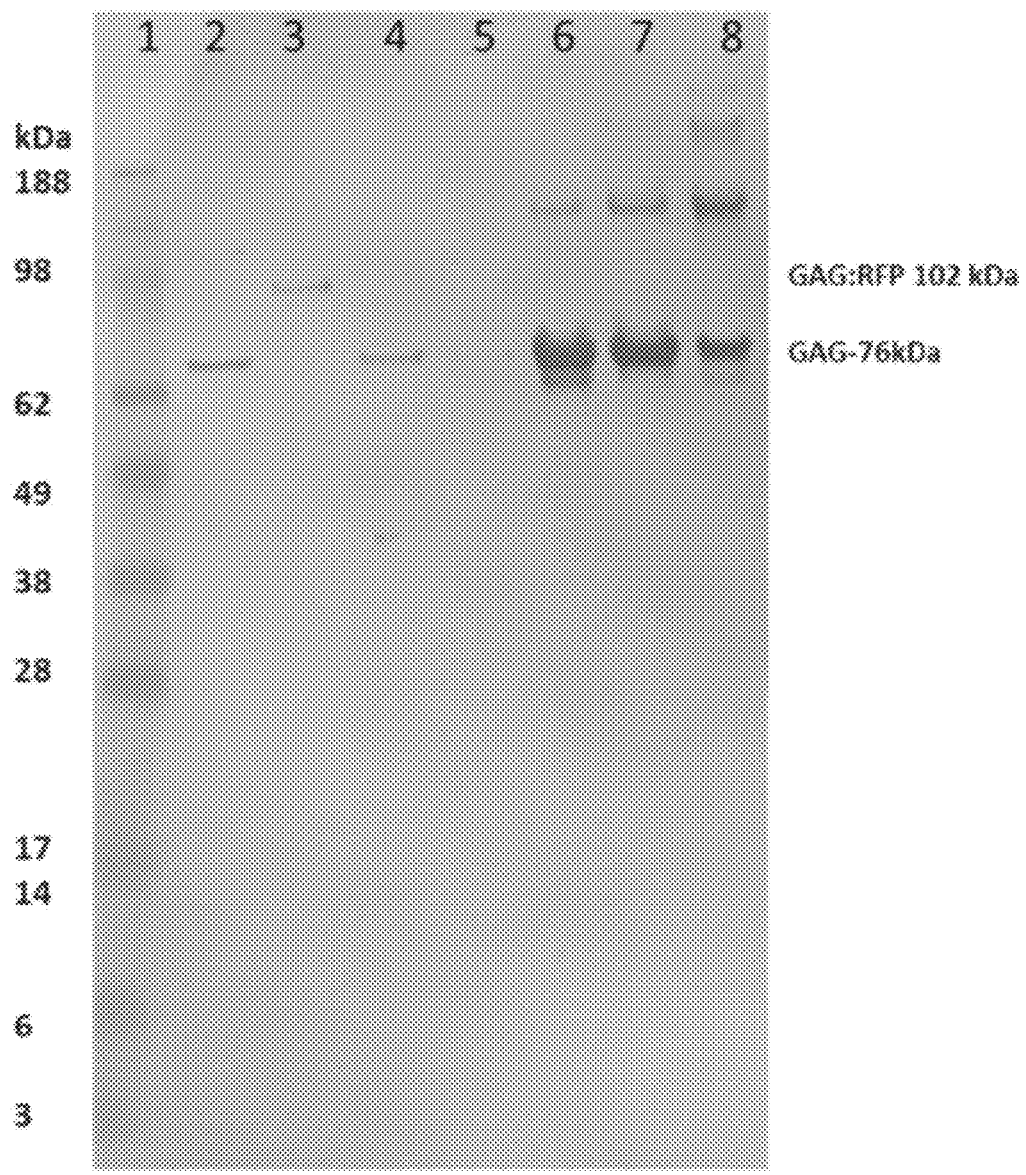
Figures 6A, 6B:
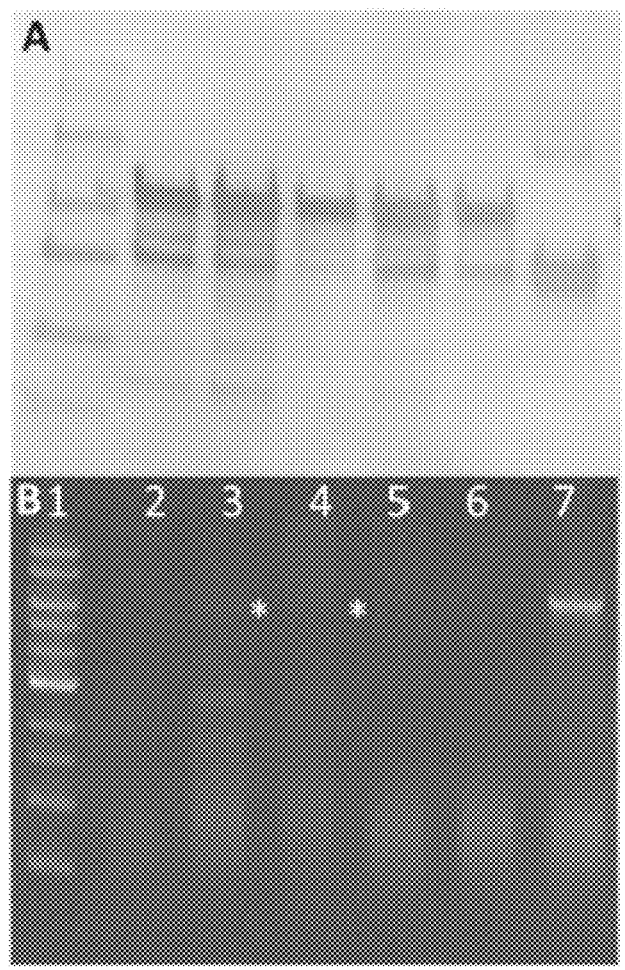
Figure 7:
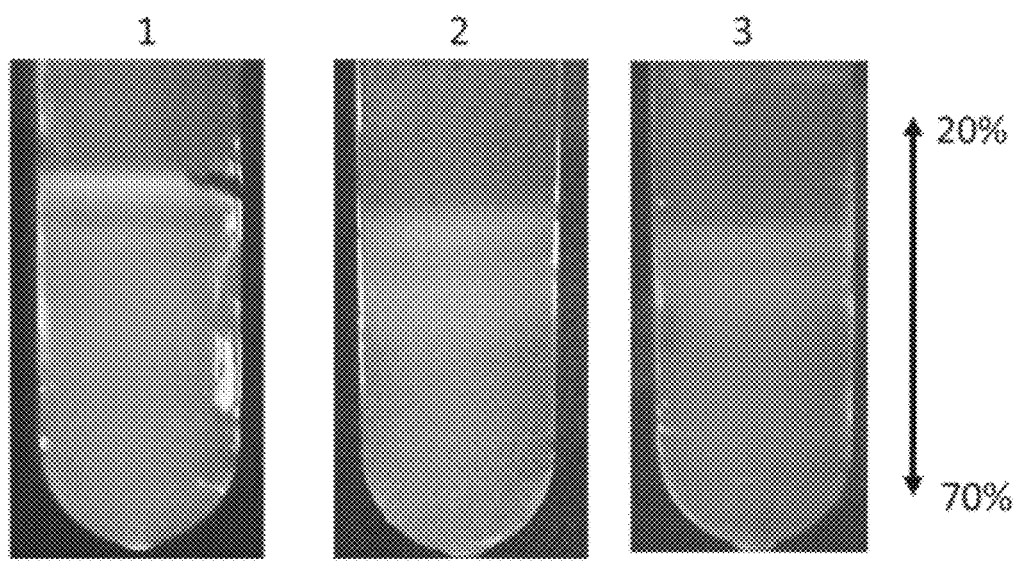

The recombinant expressed gag:RFP fusion sequence was incorporated into the wild-type capsid assembly. The red-fluorescent dsRP was harvested via sucrose gradient. The characterization of these dsRPs was carried out by native gel electrophoresis (FIG. 5) and western blot analysis with RNA analysis (FIGS. 6A and 6B). Capsid preparations were prepared by sucrose gradient and samples resolved on native gel electrophoresis, and the sucrose gradient profile shown in FIG. 7 (which also shows the ease with which capsids can be recovered by simple use of a syringe or pipette). Samples were also submitted for TEM, which samples were adhered to grids and negatively stained using 2% uranyl acetate.

Figure 8:
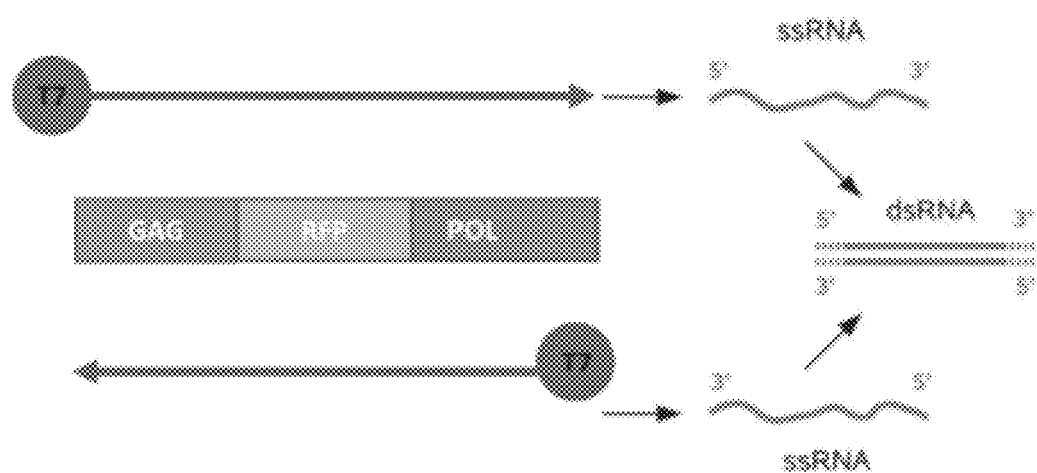

Double stranded RNA was synthesized by the MEGASCRIPT® T7 in vitro transcription kit from a genomic template with T7 ends (illustrated in FIG. 8). This was co-transformed with a selection plasmid into naïve and virus competent *Saccharomyces cerevisiae* strains. The packaged (encapsidated) recombinant dsRNA can be assembled either de novo in naïve *Saccharomyces cerevisiae*, or can be assembled and packaged in viral competent strains. After these procedures the existing native dsRNA genome will either coexist with the recombinant synthetic dsRNA, or transplant and replace the native dsRNA genome. The gel electrophoresis of control and incubated samples demonstrated the stability of dsRP preparations.

These assays demonstrated the transformation, encapsidation, and transplantation of recombinant dsRNA for both short dsRNA and a whole synthetic dsRNA genome. These assays also show that the red fluorescent dsRP has an identical or similar size and structure as the wild-type native dsRP, and that the red fluorescent dsRPs form without packaging the dsRNA viral genome.

Gag-RFP Fusion Protein
<SEQ ID NO: 1>
MLRFVTKNSQDKSSDLFSICSDRGTFVAHNRVRTDFKFDNLVFNRVY

GVSQKFTLVGNPTVCFNEGSSYLEGIAKKYLTLDGGLAIDNVLNELR

STCGIPGNAVASHAYNITSWRWYDNHVALLMNMLRAYHLQVLTEQGQ

YSAGDIPMYHDGHVKIKLPVTIDDTAGPTQFAWPSDRSTDSYPDWAQ

FSESFPSIDVPYLDVRPLTVTEVNFVLMMMSKWHRRTNLAIDYEAPQ

LADKFAYRHALTVQDADEWIEGDRTDDQFRPPSSKVMLSALRKYVNH

NRLYNQFYTAAQLLAQIMMKPVPNCAEGYAWLMHDALVNIPKFGSIR

GRYPFLLSGDAALIQATALEDWSAIMAKPELVFTYAMQVSVALNTGL

YLRRVKKTGFGTTIDDSYEDGAFLQPETFVQAALACCTGQDAPLNGM

SDVYVTYPDLLEFDAVTQVPITVIEPAGYNIVDDHLVVVGVPVACSP

YMIFPVAAFDTANPYCGNFVIKAANKYLRKGAVYDKLEAWKLAWALR

VAGYDTHFKVYGDTHGLTKFYADNGDTWTHIPEFVTDGDVMEVFVTA

IERRARHFVELPRLNSPAFFRSVEVSTTIYDTHVQAGAHAVYHASRI

NLDYVKPVSTGIQVINAGELKNYWGSVRRTQQGLGVVGLTMPAVMPT

GEPTAGAAHEELIEQADNVLVE<u>VSKGEELIKENMHMKLYMEGTVNNH

HFKCTSEGEGKPYEGTQTGRIKVVEGGPLPFAFDILATCFMYGSKTF

INHTQGIPDFFKQSFPEGFTWERVTTYEDGGVLTATQDTSLQDGCLI

YNVKIRGVNFPSNGPVMQKKTLGWEASTETLYPADGGLEGRCDMALK

LVGGGHLICNLKTTYRSKKPAKNLKMPGVYFVDRRLERIKEADNETY

VEQHEVAVARYCDLPSKLGHKLN</u>

The sequence above (SEQ ID NO: 1) is the amino acid sequence of gag-RFP fusion protein. The underlined text is the RFP sequence. The fusion was constructed under the control of the yeast Transcription Initiation Factor (TEF) promoter.

The material in the accompanying Sequence Listing is hereby incorporated by reference into this application.

Example 3—dsRP Derived from L-A Virus

Figure 9:
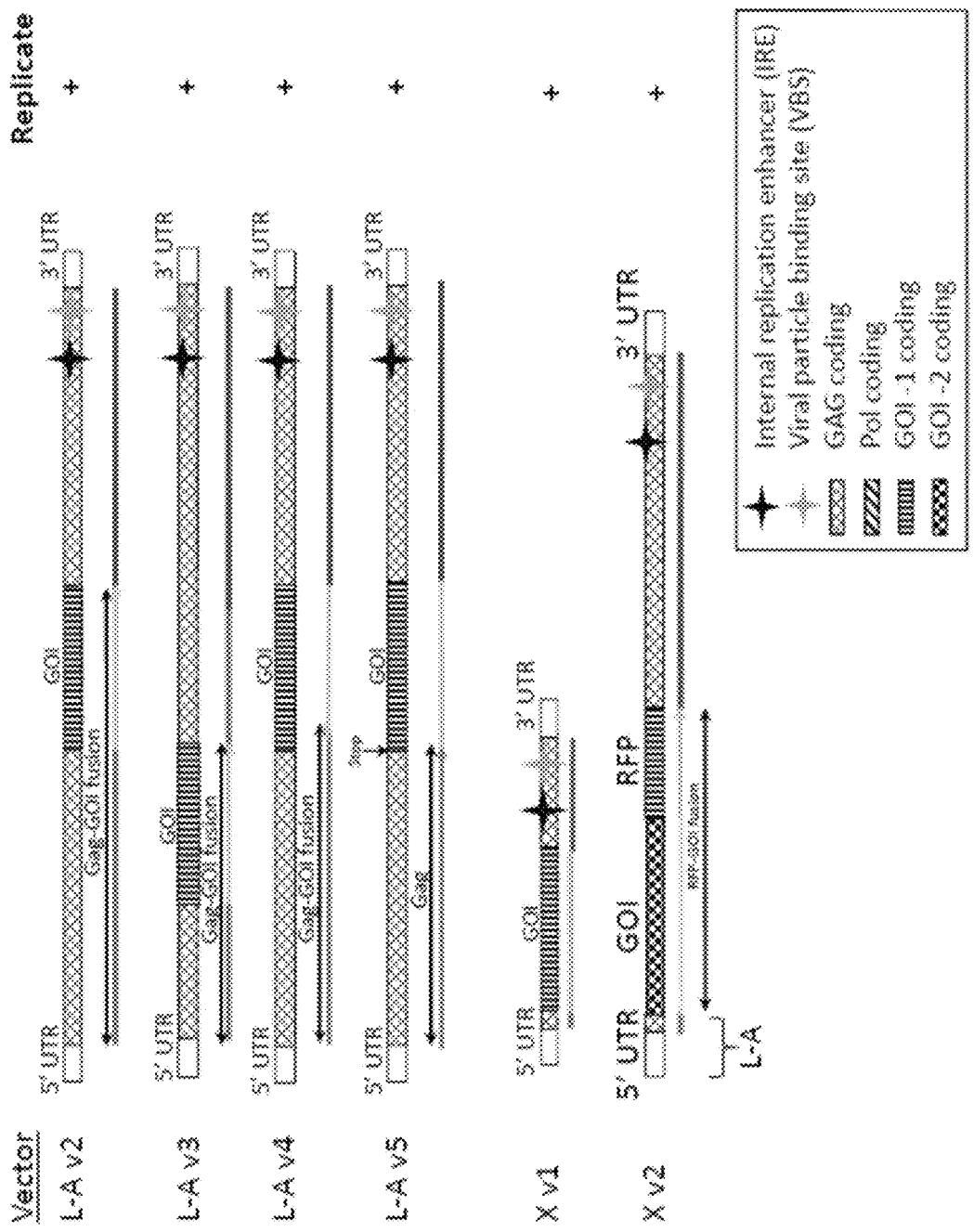

This example demonstrates replication of a recombinant L-A genome coding for a gag-red fluorescent protein (RFP) fusion protein (L-A v2 RFP) (FIG. 9).

In order to generate a positive sense recombinant L-A RNA with exact 5' and 3' ends, PCR primers were designed that amplified the L-A v2 RFP template with wild type 5' and 3' noncoding regions. A T7 RNA promoter was also introduced at the 5' end to support in vitro RNA transcription. A plasmid conferring uracil to yeast with uracil auxotrophy was constructed that coded for the L-A coding region without wild type 5' and 3' noncoding regions. The noncoding regions were removed so that the RNA transcript would not be replication competent yet still produce the gag and gag-pol proteins. The combinations of RNA and plasmid DNA examined in the experiment are shown in Table 2. RFP expression was detected only in cells that received both the Gag-RFP fusion recombinant RNA genome (L-A v2 RFP) and the Gag:pol plasmid DNA. In addition, RFP expression was maintained only as long as the cells remained under uracil selection indicating that the plasmid driven gag and gag-pol proteins were responsible for replicating the input recombinant genome. These data indicate that recombinant L-A genomes not only drive production of dsRNAs to induce target-specific RNAi but also express recombinant proteins of interest in yeast.

TABLE 2

| RNA/DNA transfected into yeast | RFP expression |
|---|---|
| L-A v2 RFP RNA | Negative |
| Gag:pol plasmid DNA | Negative |
| L-A v2 RFP RNA + Gag:pol plasmid DNA | Positive |

A representative schematic of dsRNA vectors that have been examined for the ability to replicate in yeast when the gag and gag-pol proteins are provided in trans from plasmid DNA is shown in FIG. 9. All of the recombinant dsRNAs have been shown to replicate in yeast cells.

To demonstrate that replication of recombinant RNA genomes is occurring through a dsRNA intermediate, a primer was designed to anneal to the negative strand partner of the dsRNA that could be used to generate cDNA. Because only positive sense recombinant RNA is used to transfect cells, detection of the negative sense RNA is evidence that the dsRNA replication intermediate is being generated in the yeast.

A recombinant L-A genome coding for 1100 bp of the shrimp clotting protein gene was constructed (L-A v4 clot). The L-A v4 clot construct was amplified by PCR to introduce a T7 RNA promoter as described above and positive sense RNA was produced from this template. Positive sense L-A v4 clot RNA was transfected with Gag:pol plasmid DNA into yeast with uracil auxotrophy and individual colonies were isolated. Reverse transcription PCR (RT-PCR) analysis of colonies using a negative strand RNA clot gene-specific first strand primer revealed amplification of a clot PCR product. These data indicate that a negative strand RNA was generated during replication of the input positive strand RNA.

To show that recombinant dsRNA genomes are packaged into capsids an L-A v4 clot yeast clone was grown up, the cells disrupted by microfluidization, and the material centrifuged with the supernatant was collected. Capsids in the supernatant were partially purified by pelleting through a 45% sucrose cushion. The pelleted capsid material was then loaded on to a 20-70% sucrose gradient and ultra-centrifuged overnight. A visible capsid band was collected with a needle and syringe from the 20-70% sucrose gradient and dsRNA was extracted from the purified capsids. The purified dsRNA was used to generate cDNA using random hexamers and the cDNA was submitted for sequence analysis. The complete sequence for the L-A v4 clot recombinant genome was identified in the sample, therefore confirming that the sucrose gradient purified capsid contained LA v4 RNA.

Example 4—Toxicity and Biodistribution

Gross toxicity and biodistribution of both purified dsRP as well as whole cell preparations was assessed as follows. For dsRP material two preparations were examined by injection in post larval pacific white shrimp (*Litopenaeus vannamei*). One preparation was purified wild type capsids collected from strain 18 yeast and the other was capsids generated by constructing a gag-RFP fusion protein gene expressed from plasmid DNA transformed into strain 18 yeast. The expressed gag-RFP fusion protein spontaneously forms capsids that contain the RFP reporter protein. The wild type and RFP capsids were either partially purified by centrifugation through a 45% sucrose cushion or further purified by centrifugation through a 20-70% sucrose gradient. The two types of capsids (wild type and RFP), from either the cushion or gradient purifications, were used to inject shrimp. No signs of toxicity were detected in any of the injected shrimp with either wild type or RFP capsid preparation.

Biodistribution was followed in RFP capsid injected animals. Red fluorescence was detected at the injection site at 2 and 6 hours post injection but could no longer be detected at the injection site by 19 hr. Gill associated RFP signal was first detected at 6 hr post injection and was evident at 19 hr post injection. As expected, animals injected with wild type capsid material showed no RFP signal at either the injection site or in gill tissue at any time point. These data indicate that the RFP capsids changed distribution from the injection site to distal locations with passage of time.

Gross biodistribution and toxicity of whole cell preparations in shrimp was also studied. The whole cell material was provided to animals in two ways 1) by provision with shrimp feed as a cold extrusion preparation (~0.2 grams wet weight yeast+~0.2 grams ground feed/alginate preparation) or 2) by simply immersing animals in water containing whole cells. The details of the whole cell shrimp exposure are summarized in Table 3.

TABLE 3

| Whole cell preparation | Feed | Immersion |
|---|---|---|
| Estimated dose | ~30 mg yeast/shrimp/day | ~0.3 mg yeast/ml sea water |
| Length of exposure | Feed animals for 5 days | Day 1: Maintain shrimp in static aquarium with with heavy aeration Day 2: drain yeast water replace sea water with ~0.3 mg yeast/ml sea water and maintain shrimp in static aquarium with heavy aeration |
| Time points of analysis | Day 6 | Day 3: transfer shrimp to fresh sea water and collect samples at T = 0 hr, T = 6 hr, T = 24 hr |

Animals were fed shrimp feed containing whole cell material for 5 days and samples were analyzed on day 6. As expected, no fluorescence was detected in either intestinal or gill tissues of animals fed wild type cells. Fluorescence was detected in both intestinal and gill tissues of shrimp fed whole cells containing RFP capsids. No mortalities or toxicity was noted during the time animals were fed the whole cell feed preparations.

Example 5

Figure 10A:
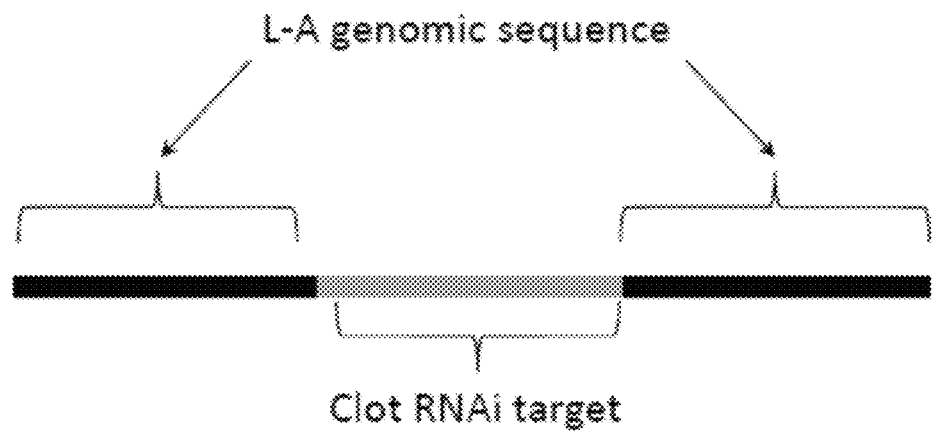
Figure 10A:
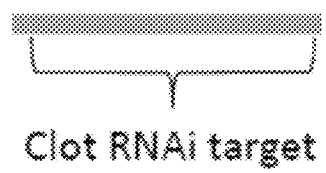

To demonstrate that a recombinant RNA sub-sequence in the L-A genome sequence can induce an expected RNAi effect, a recombinant L-A genome coding for 1100 bp of the shrimp clotting protein gene was constructed (L-A v5 clot) (FIG. 10A). A T7 RNA promoter was engineered at both the 5' and 3' ends of individual clones so that both positive and negative sense RNAs could be in vitro transcribed as described above. In order to reconstitute a dsRNA, equal amounts of the L-A v5 clot positive and negative sense ssRNAs were combined, heat denatured and re-annealed to generate L-A v5 clot dsRNA.

Figure 10B:
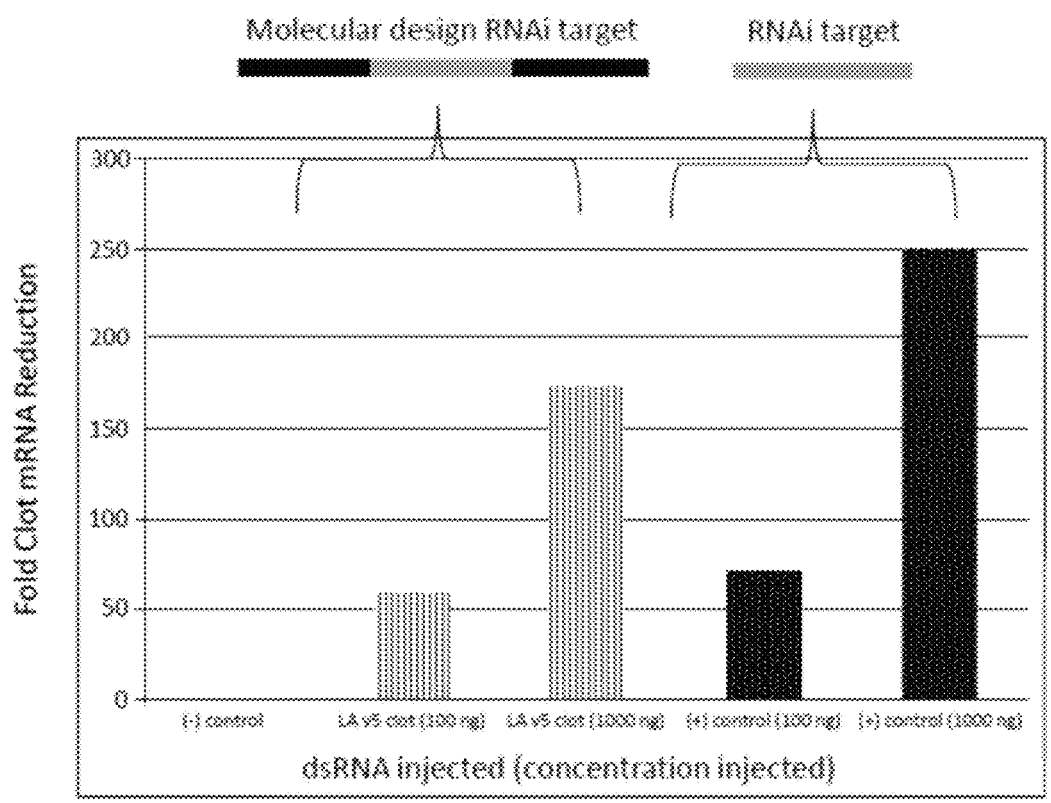

Two concentrations of L-A v5 clot dsRNA were examined for the ability to knock down the endogenous shrimp clotting protein gene by injection. Identical concentrations of the 1100 bp clot dsRNA were injected for comparison of RNAi effect on gene knock down. The fold reduction in clot gene mRNA, normalized to control for dsRNA copy number injected, for both dsRNAs is shown in FIG. 10B. The clot RNAi target in the L-A v5 clot dsRNA demonstrated very similar knock down of clot mRNA at both dsRNA concentrations injected into shrimp. These data indicate that recombinant RNAi carried by the L-A dsRNA genomes are as effective at reducing targeted genes as the RNAi target sequence is alone.

Studies designed to demonstrate that dsRP engineered to contain a portion of the shrimp clotting protein gene are capable of knocking down the endogenous shrimp clotting gene by delivering dsRP or dsRP whole cell preparations by injection, oral feeding and immersion are described in experiments 1-4 below.

Example 6—Clot Gene Silencing

This experiment will show that administration of a vaccine formulation of the invention to pacific white shrimp results in expression of the encoded sub-sequence of the RNA molecule, which is directed to clotting protein. The control dsRP in this experiment is derived from L-A virus and is modified to contain an RNA sub-sequence encoding red fluorescent protein (RFP).

Post larval pacific white shrimp (*Litopenaeus vannamei*) (0.5-1.0 g in weight) are maintained in 10 L aquaria. The formulation was administered either by injection or orally with feed mixture or simply by inclusion in the water in which the shrimp live. When injection is the method an injection volume of 20 ul is used. Oral delivery occurs either by immersion of shrimp in seawater containing 0.3 mg yeast/ml of water or as a whole cell and ground shrimp feed mixture prepared by cold-extrusion. The estimated dose of whole yeast as a shrimp feed combination is about 30 mg/shrimp/day.

Injection Delivery Studies

Individual shrimp are vaccinated with varying doses of dsRP vaccines by injection. Initial studies examine the knock down of an endogenous shrimp clotting protein gene as a measure of how well the dsRP induces an RNAi effect with the delivered dsRNA. The relative abundance of the shrimp clotting gene mRNA is measured at varying days post injection by quantitative RT-PCR (qRT-PCR) after treatment with dsRP whole cell preparations in order to determine the duration of the RNAi knock down of the shrimp clotting protein mRNA. Injection of dsRP-RFP (red fluorescent protein) or PBS are used as the negative controls in these experiments. A 1100 bp region of the shrimp clotting gene is used to produce a dsRNA sub-sequence directed to the clotting protein mRNA, and this is used as a positive control to knock down the endogenous shrimp mRNA. Relative knock down of the endogenous clotting protein mRNA is found to be dependent on the dose of vaccine examined. That is, higher doses show higher knock down of clotting protein mRNA. Significant RNAi knock down of clotting protein mRNA is noted as late as 20 days post injection and also is dependent on the dose used. No clotting protein mRNA knock down is noted in control vaccinated animals.

Oral Delivery Studies:

The ability of dsRP directed to a shrimp clotting protein to knock down the endogenous mRNA is also determined in animals for oral routes of delivery. Shrimp are exposed either by immersion or by consuming the dsRP directed to clotting protein either as whole cells in the water or as ground shrimp feed preparation containing the dsRP. Animals are immersed or fed for 10 days and then the level of clotting protein mRNA knock down is measured by qRT-PCR and compared to mRNA levels in the negative control (no treatment) and dsRP-RFP non-specific control animals. It is found that, similar to the injections studies, the level of clotting protein mRNA is reduced in animals administered the dsRP directed to clotting protein by both oral routes of delivery. Based on these results dsRP are constructed that are directed to the VP28 gene (SEQ ID NO: 71) from white spot syndrome virus (WSSV) as an RNAi target to be used in vaccination and challenge studies in shrimp.

WSSV Challenge Studies

Based on the demonstrated RNAi capability of dsRP preparations to knock down an endogenous shrimp mRNA a new dsRP specific for WSSV is synthesized and tested to show the ability of the dsRP to protect shrimp from a lethal WSSV challenge. Animals are challenged in the following manner. One shrimp not involved in the study is injected with a lethal dose of WSSV and is released into tanks of vaccinated or control animals. The WSSV injected animal succumbs to the infection in a matter of days and the vaccinated or control animals cannibalize it and thus become exposed to WSSV infection. Mortalities in the different groups are then followed over the course of the study. All animals are either immersed in or fed dsRP WSSV vaccine for 7 consecutive days. The day that shrimp are challenged is varied to include different time periods post vaccination. Animals are challenged either one day after the vaccination or 2, 4 or 9 weeks after vaccination. Significant protection from WSSV challenge is noted in all dsRP WSSV vaccinated groups even out to 9 weeks post vaccination. dsRP RFP and negative control (no treatment) groups uniformly succumb to WSSV challenge.

SEQUENCE LISTING (103 sequences)

SEQ ID NO: 1 - protein, 916 aa, Artificial Sequence
  Totivirus L-A and Whispovirus wssv. gag-RFP fusion protein
MLRFVTKNSQDKSSDLFSICSDRGTFVAHNRVRTDFKFDNLVFNRVYGVSQKFTLVGNPTVCFNEGSSYLEGIAKKYLTLDGGLAIDNVLNELRSTCGIPGNAVASHAYNITSWRWYDNHVALLMNMLRAYHLQVLTEQGQYSAGDIPMYHDGHVKIKLPVTIDDTAGPTQFAWPSDRSTDSYPDWAQFSESFPSIDVPYLDVRPLTVTEVNFVLMMMSKWHRRTNLAIDYEAPQLADKFAYRHALTVQDADEWIEGDRTDDQFRPPSSKVMLSALRKYVNHNRLYNQFYTAAQLLAQIMMKPVPNCAEGYAWLMHDALVNIPKFGSIRGRYPFLLSGDAALIQATALEDWSAIMAKPELVFTYAMQVSVALNTGLYLRRVKKTGFGTTIDDSYEDGAFLQPETFVQAALACCTGQDAPLNGMSDVYVTYPDLLEFDAVTQVPITVIEPAGYNIVDDHLVVVGVPVACSPYMIFPVAAFDTANPYCGNFVIKAANKYLRKGAVYDKLEAWKLAWALRVAGYDTHFKVYGDTHGLTKFYADNGDTWTHIPEFVTDGDVMEVFVTAIERRARHFVELPRLNSPAFFRSVEVSTTIYDTHVQAGAHAVYHASRINLDYVKPVSTGIQVINAGELKNYWGSVRRTQQGLGVVGLTMPAVMPTGEPTAGAAHEELIEQADNVLVEVSKGEELIKENMHMKLYMEGTVNNHHFKCTSEGEGKPYEGTQTGRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRCDMALKLVGGGHLICNLKTTYRSKKPAKNLKMPGVYFVDRRLERIKEADNETYVEQHEVAVARYCDLPSKLGHKLN

SEQ ID NO: 2 - protein, 6077 aa, Artificial Sequence
  Whispovirus wssv. >P5MICT165251 (VP664)
MDQYPEVRDTPQTEQEQAAAQQQQAATTTAAAAAAAAPTQYSNTVSAETLSAISEDGKLERSIAASCWINNLNPDEKMAQRVQFHPLSSTTTYDSENVNPGSSVVFLKPRALPTGGTCLAPNYIAVPTLRAASEIIDSIASTSLYQCSMFNSWNLIPIFMSNSKHSQFGDRVIKRSMIRNCFSKQKNVENLLKELRRRKVNAAKAFSHAVQQKSAVNTALAAWNAGSAANLEKLVDFCKLKYSPDRKYKAGGLFSASATAQSQSGTSSSSVEHTSNDFLLDILKRHKGTSLDLDSATNTFDTALSRVFTEFKEQARAAVDAAADSDHLSASDPIFSIVRHNSRREGILDSVPNIGMLAPRSKYSVAEYLMADRDESADIAAKIGTKIATDFEALRGDNNKRRADTSVDDLKESLADSIEKTSIKNTGDINSVTNIPTDTEEYEFSLHITQLFAQAFLETMGSLLSCAFGVQFPFSDEGFAAIERIIRKTDPDTGKVSEMDPSSLSDQYLLLVGNFQVSPFHVSDPKDIVFGRQVTPNTPILSIITRSKNDKNETSTIINFRDRLLVNDTVLRDATQNVSTSTPSQRRVPTAAGEPKKPMLSGCLPIIRGPQVVTRESDDMISGLVGDWYISLGVYYAMGSSAAAIAAGHQRALASAESINSPMMKKFSKKGGKYTEEEKRIKKAMRRNADRSARILALLGQTDAQYGYVEHNSTLDSFWSSNAAIRAKAKEDALSRAEILAVRKQLDGKCSSSRDEYSMVERYLRDSFFRSVNRSGGGYEMFDQGFDMGRFADFLSDNSAARNAWQQYAEVMRGLSKHEKRVFNIEGLFSALNSFKFPLVPEQGRKKTVGGRHRLNNLKAANKIINGITEMTLQSAIDGTGISDIIGSVSDGWGNTTAQPSRVKALKTLSNFSGNGNVVSIPVSRAVKCAAGSRGGETLKCVDIPSVIIANLISDKRILDQLCGGGMNLAHEITNFIETIAGKEHTGKESVFLSPRLSVILLRYIWFNAAVVSLTDSNIKMPLNTMSEGTGDDIYRDYLAIRGMVNNYNSSLSSISVKAISDRYNCGSGNTSTSNKNVTIKTQGELLTVLQQTANALSAFTNKGGVGATPDAANMANVISPIANADVVKNTNVVVSGLDRITETINFFSFLSQIKTMNENIEEYLRRYRLGEGLDKKELDNFVYPNIAAIVKRELGVSGSALSSNLDTDRPITIDLNTEQPLIVKASKGYASNRYAKLFNKTTRTAAEQAQMEQYNAQMAANTIPQLVNRLTIPGSITADTAINVVKAFTENGEFSNAETHLGVMGNAINEMQPLFTDGFNVANKRLTVNVGSVSKLIQNGLTVSLILAHSKASPYVFKPLVQDFAKLLLAVTAETSLVVSRSQKSFFPIPPSVFSSGGLFKIDREMFDNMKTDYVVEVIRQLSKNATAAIERCNDSDSAARIAKSGEIYNKDVASTTAAPGTSSSALTLFANNLQNPAKVWSMGALPHFDMAVVPKLHGISHDQMFRLSTYYQGIHKMELNSDCKPEEWDNSLPGNRASKFFGLSSVSDNNRSFNLALDTLLASPAEICDLVTREMVKTSNDIVHNIGSNSNTDALQKSLQVGASAVEKYDESTLSTKETDVYSLVSALAKSKSPLSSSSSLSSEGHLTSKEIDRTWNTPALLGTAKTTSYSVSEDALNAPLSAVLDFRRNVVDATKSLYEVAAVCSVMSKEEDVRSSSRKIMGMVEQESPVMQDIGIDRIASLVSTVATPKQHRRFLQTVNDYKNYLIRKVASNPLLSSRLGGISPTSGNTDYNLKAVYDGVVSSSSSMTPSSMSVSDRFWSGVFSQCLETGPSMFADAGHGGSNMFQITAPKLYGSRVNTYAALSSGVERLRDSISSATQERKNRIAKSIEALETFVTDVVGGDTLDQLRKAQNMYNKLSDITSNSIYSDFGNIDCAKIMKNVTSKKMTARQQSDTILSSLLHELAGLVHKQQPQLATQFALASHVIKAKYVTNDLNNIHEKETFSQLMAVAGVADYYNVSAAAMCQRLVASDVTMFLGGTMLQQGLFVSFLLNNVLFSQVSDNIKMNELNDETKSLLVKLVGFCGTVSDALGSRHVSSIRRVQNEEDKKLDRSFVTSLYSAYRDLRKKTELYRETDTINKLFGHQNFMSYESSMLKRTSLVHDAVSGPRPRRYSTLEDVLEAPSTVHKSFMVSYPERAAASRRVKRAGLRALADNRMESLYGEEVLNDMRSSAVSSEMMDIEYGEGGFMMMISDDEDDIAFIDSEEESESSTDFSSSDEYSDSSDEYDFDDDNNGQSPYSTTSYSYDALDRLNSAAKPLTAIYGCRGEGEDDEENDLYEEEQERRRRRSSKMGKILRDLHESDDDDDDYFDDEFDGERSMSETIATRRAGRIQYGPGFLSHSNILNRPAKARAFLTRGKKFRPSAYDRFFMEDDDSLLFSDESTTSSSSSDSPFSSFSKGRKCKRRTSEDQCAFVKRVVRAFVPTRVTMINGRVSMITPVTSENTVGFYENYQKANKRERARLIEEYKIVKGASATLPDEYVEGRASKQVSPRELRRSLIKAAAYVARTQESNLNIIFDALTTTSNATLVNDPSTLLGDTLLFAKQLEAITERRNRLMKDLTEISPSLFTSFGDASKDTQMMADAKQIVSGGNFKSAGYLGVPLRTLASCIKGTNTVDRLLATKNKNHLEWMTTAAIVFARSFNDTTFHALEDTLKMTSALTDMYSAFTNLVGSEHSQRLKVKSTLLDSIFNTRMAHTEAVMGLVYPTAFINHEMPSDYTQRREMQSLALNILRGVNCSQLPRKDIGDTAGLLTFITSRKFAGYGGERGGLSLYRMSIVDALSCPSDNRLKGAVSLEVGKWQDMGEEIFYKRSNDLVDFCSKNNISLENAVGPIARFVPNGTNMADIGMTDIISRTVKDDASMIRLRRAEEGAGAAGKFITASAMGNLYGGIDTVVNLTEKLYDSFVLLQDSDSFNTPTEMATAIINRMKSRKHKALKTPFGGDIATYKNFPSSSEAIVVRAKEMRNSISTIVMDISKSRGINSFSSRSGSTLAKISTSEFERILETSAVLSNTKANLRTIENRLAEHYNKLKQFSHISNDGLSETRAVVAVIAESLTPVYADDTSERGASVSELLTDNTLLKFIVQNELKNIEEAKRHVTAAIEGSSQLHEKMLSLLVASADINRMSAQNNLECKKLTEGNSNFVPMTNDQGGTFIKHKETGIWLKTDEENNTSSIKDNDQRRVAKTILAIVEDNRNATIRSRLQSLCFGKYAMNDIFALDDADIKNMDKLIEKLGEALAEKASPSSSAISSSSSSNTTSSSSSPSSSPSSSSSSFSMDYSNNLAKTIPYMPIVFQNKQSNVNSSDASSSSPSSSSSSSANIDNVEHKKVALQQLQTQESNDLSNVLSVTTKHRFASHNQAATVGIFNGRQHAETVVAIPNANKANNNATVSAGQGILTRFSAPENVSSTSMQLPPSSSSSSNGDDNKVPVTVRLNQYANSILSSIENASEFKDLKEAERKIDLAIQAASTTETKEMVTVSKCPSANQTAITAISQAKSLKKSALELLERVIKAVEVYTPDSSIAAVSLPVNGDSMVSSSSGSGSAPSSSSSSSSSSSSSNVTDYFNYAYGKLKNIDENTEEGAETVQKNMVEQDAAVRIPLLVSYAPFSEMMRRAIDKLNEYYQLIDAIKTKIVSDTKQASSWAIKETDKELDMDKEQVISKINNLQQNFSNESDKIKMAISVLDNKRNELELQNNKTRSFIETTKSRIEAGGGDVANFKEIIDYENTSENDNNLFQSLKAFAADNSGTVYTPTDMSNGRDTKSDSKFVDMYNKQILEGGIKLINEGQNTVKVDFSKALEAFPRQSNGASEPVSSSVVERRQRERLQAVEMFMAIMMERTESLRKRLADSAAQWNTVNNVEETVNSGMVNIKSERLTEIRNQAQIAESTALNSINDEIVESPLTLSLGARVDQLLIKVDRVGSIQQQQQQQQQQQQLPKLTATEQRKEQQYAADRVVYDPSYTCFLQPLHETIKRISSVYNSKNKGPLSNTRGVPTSDADLQLMTITDLSRSVLDSSSTSSKKMLYENVPSSIVPGLCQQCAMMITNVHEATHTSPHSFNFENKRSLKQLTEMLNAATSSSDGPAVRHDVLTMLESNNGYVKDFGFTHRQKVACITPVNTLLGGTFSGNVAPNTVILPTSELFNCPGVENDKFRSMVNRTTDKNVADAPKSSASIVETLARTSPNAEHLYFPFKDQRRHFNSITDAIISGMSGESSSQLNTTCDQNLVNIDQTTGFPVFTGRKQGERRIVHTENTMEGARKDKNSGIPSCTKDRQTYIDMGTKFMVAPGSLLNANKEETLRLNRLSDINNVRHYGTDVHVAGANSAWRIGEVVRAASSFPDGDKESAMKKMLLLGSVSAISAQKSASHINDPTALLSTNTSIQNLVKEAFPDPVCSSNYLGSAESTFATQLAYRQRLFPNGDDENVTTVSNICPMDLMGSTKRYNDAFNNIFGSKMTSTNKKGSNCENLLKSAMSNVPAINTAFGAFEEASSSVRNRLSPLYEDSTKYSSNQLAVQAMTDTAVDALSAVSTVVGRQNGRNTLLSLPTSITSIATSGRPSLSYSSDMKSNLIKTISRINRDASLLSMGDSQVAAGSSFFNSFLRSSSIPVTTSQDGNVAAAEIVLGTILDKTVEINKRFEMLGGGKMVAGSPEARAIQRNTMSSILQMNENELARDLCEIENKIETRQLRDAFQDLKRSMLMTPGGVGAISSGASTNNVPLSLLMSRVDASSGLLMNNNSANVMEAVDSFNTTPLLVRHMMLDSGKSPVPMAKEIRSMLTQPRALTARALLSESSPLLTEICLYNTRDTQPERAVDRLLTSAYLVKQAKRFDGVDPAFPAALTCASHLMLSSMDSHTKSSFMDNIKLHMTDTQCFFKNIERFEKFLGRYGDEYAMSHKQNCNCPFHLHHTFTPSDNEHLVSSFAFARPEVSMEEIRATPYQANKLISDKHYVMNMSKIDSRVTGSSLLKKVSEWTEMRMNSNFNGTFEPSRLALSNSGMTTAGVNLDVIVKPNNARSVLGILECHRQHVCTADAKGTVASAMPAVFQATDGNGNESELIQNALPRNRYIQKSTMNAQTVVFANVLEQLIADLGKVIVNELAGTIAESVPESVYENTKEMIDRLGSDDLFKSNNNGGVESMDYEDSETTSNNGPVLISEAMKNAVYHTLISGKAARPENVPFASCASGPLAFDFLLSKGDTFEEKNAEQGAAAAVSSTYSSSSNTTLRKHLARVFEAISKQVTDAEFKDILNDIERNISSDYTNCPPNTNQNAFALAIKREFSRIVSFLTILRKNITPALVDPKGALHEKVAIYLTLLSTKSKLENFFQYGLSNSSSVDLSHLKPINCSNNVKNIEDTFMYRNVHPILIMALPENFTALLQQEQMDPDTAIESRRSLTTFLNHPNTASMANGARAAVGAGGGNPMGLYLSSHILHESTVTTSNPVTDTTENVNYHSSVTQDPVMVVNPFKDSARLIVNNNNTGIDVLNDKSCNYLQVSMPSESSGLVTNTGCSSSSSSSSSDTFKYVRRDNTPVNLPRVTPAVLCSDASSNLLDVFSRADIVLENMNVRFGFMPEIIAAVSKFKGLTKEEVIKQMVSQNNINNNSNNNNGNGKKTTVDPVTGDIVITNATFPDTRPLYTAANGGTSSFKWGDINDRKMHAKAFPTFFIGNPTAAATANGVPLTSEGISLTEEKRKKIAGISEGSIGTGALRAAANTRLSSDMEPVMKGWNNIVQLQQTFKKASDKLTHLLRSGGIPPRSQETNAIINKMHDSFKTLEECRRVIQDEAALLVATSDLLTGGYGGDAALAMVSPVRPEMTGLIGAISAPVRGISHLLKLGGVSAANAAIRKRLNLPTSNGKTLPEHGIVHKSAKTLLLDSDSISNLYNTDLQDVVSNARDNNNLGRIMQSLGLKGNNAGDLVYSARQLTDLITVPEYGNNRDLTKRQAILKMLISNPEILENVADTIYLTTGKNALAPVSAQEMACASLTVGGSGGGKLSSDDNVQSLNRLYFRV

SEQ ID NO: 3 - protein, 18234 aa, Artificial Sequence
  Whispovirus wssv. >P5MICG165251 (VP664)
ATGGACCAGTACCCAGAAGTGAGGGATACTCCTCAGACAGAACAGGAACAGGCGGCGGCGCAACAACAACAAGCAGCAACAACAACAGCTGCCGCTGCTGCTGCCGCTGCTCCTACGCAGTACAGTAACACTGTTTCTGCAGAAACTTTATCCGCCATTTCTGAAGATGGAAAATTGGAGAGGTCAATCGCAGCTTCGTGCTGGATCAATAACCTTAACCCTGATGAAAAAATGGCTCAACGTGTCCAATTCCATCCACTTAGTTCCACGACCACATACGATTCAGAAAATGTGAACCCTGGTAGTTCTGTTGTGTTTTTGAAGCCTAGAGCCCTCCCCACCGGGGGCACGTGTTTAGCCCCCAACTACATTGCAGTGCCTACTCTTCGTGCTGCGTCAGAAATTATCGATTCTATTGCATCAACTAGTCTATACCAATGTTCAATGTTCAATTCGTGGAATCTTATTCCCATTTTTATGAGTAATAGCAAACATAGTCAATTCGGTGATCGTGTCATCAAGAGATCAATGATCCGTAATTGTTTTTCCAAACAAAAAAATGTAGAAAATCTTTTAAAGGAATTGCGCAGGAGAAAGGTTAACGCCGCCAAGGCATTTTCTCATGCAGTTCAACAGAAATCAGCAGTAAATACTGCCCTTGCAGCATGGAACGCGGGAAGTGCTGCAAACCTCGAAAAATTAGTAGATTTTTGCAAATTGAAGTACAGTCCCGATAGAAAATACAAAGCAGGAGGTCTTTTTAGTGCGTCAGCAACAGCTCAGTCACAATCAGGTACTTCTTCTTCCTCAGTTGAACATACTTCTAATGATTTCTTACTCGATATCCTAAAACGTCACAAGGGAACGTCCCTTGATTTAGATTCAGCAACAAACACATTTGATACTGCTCTTTCTAGGGTTTTTACCGAGTTTAAGGAACAGGCTAGAGCAGCCGTAGATGCAGCCGCAGATTCAGATCACCTATCCGCGTCGGACCCTATTTTCTCTATTGTTCGACACAATAGCAGGCGTGAGGGTATTCTAGATTCAGTGCCAAATATCGGTATGTTGGCTCCACGATCAAAATATTCTGTCGCAGAGTACTTGATGGCAGACAGAGACGAGTCTGCAGATATCGCTGCTAAGATAGGGACAAAGATTGCAACAGATTTTGAAGCATTGAGAGGAGATAATAATAAGAGAAGAGCAGATACTTCAGTCGATGATCTCAAAGAATCACTAGCGGATTCTATTGAAAAAACTTCCATTAAAAATACCGGCGATATTAATTCGGTCACAAATATTCCCACAGATACAGAGGAGTATGAATTTTCTCTCCACATCACACAGCTTTTCGCGCAGGCATTTTTGGAAACTATGGGAAGTTTATTGAGCTGTGCTTTCGGTGTACAGTTCCCCTTCTCAGATGAAGGTTTTGCGGCTATCGAAAGGATTATACGTAAAACAGATCCTGATACTGGAAAGGTTTCAGAAATGGACCCTTCCTCTCTTTCAGATCAATATCTCTTGTTGGTAGGAAATTTCCAGGTTTCTCCCTTCCACGTTTCAGATCCTAAGGATATCGTTTTCGGTAGACAAGTTACGCCTAATACGCCTATTTTGAGTATCATTACTAGATCTAAAAATGATAAGAATGAAACGTCTACTATTATTAATTTCAGGGATAGGCTTCTTGTTAACGATACCGTGTTGAGAGACGCCACGCAAAACGTCTCAACTTCCACCCCTTCTCAAAGAAGAGTCCCCACCGCCGCAGGTGAACCAAAAAAGCCAATGCTCTCTGGTTGCCTACCTATCATCAGGGGACCCCAGGTAGTGACCAGGGAAAGTGATGATATGATTAGTGGTCTTGTGGGTGATTGGTATATCTCTTTGGGGGTCTATTATGCCATGGGTTCATCGGCTGCAGCTATTGCCGCTGGCCACCAGAGAGCTCTCGCTTCAGCCGAGTCAATTAATTCACCCATGATGAAAAAATTCTCAAAGAAGGGAGGAAAGTATACAGAGGAGGAAAAGCGAATCAAGAAGGCTATGCGTAGGAATGCAGATCGTTCTGCTAGGATTTTGGCTTTGTTGGGGCAAACTGATGCCCAGTATGGGTATGTCGAACATAATTCTACCCTAGATTCGTTCTGGTCTTCGAATGCCGCTATTCGTGCAAAGGCAAAGGAGGATGCTCTTAGCCGTGCAGAAATCTTGGCAGTTAGGAAACAATTGGACGGAAAATGTTCCTCTTCAAGGGATGAATATTCCATGGTAGAGAGATATCTTAGAGACTCATTTTTCAGGTCAGTTAATAGGTCAGGAGGAGGATATGAAATGTTTGATCAAGGTTTTGATATGGGAAGATTTGCCGACTTTTTGAGTGACAACTCTGCTGCCAGGAACGCTTGGCAACAGTACGCAGAAGTAATGAGAGGACTTTCTAAGCATGAGAAACGCGTATTCAACATTGAAGGTCTTTTCAGTGCTCTAAATTCTTTCAAGTTCCCCCTTGTTCCAGAACAGGGGCGTAAAAAGACTGTAGGTGGAAGGCATAGGCTTAACAATTTGAAGGCGGCCAATAAGATCATTAACGGCATCACAGAGATGACTCTCCAGTCAGCCATCGATGGTACTGGAATCTCTGATATTATTGGTTCAGTTAGCGATGGGTGGGGAAATACTACAGCTCAGCCGTCTCGCGTCAAAGCTCTTAAAACATTGTCCAATTTCAGCGGAAACGGAAATGTTGTGTCAATTCCAGTTAGTCGAGCAGTAAAGTGTGCCGCGGGAAGTCGAGGTGGGGAAACTCTCAAGTGTGTGGACATTCCTTCAGTCATTATTGCAAACCTAATCTCTGATAAGAGAATTCTAGATCAACTTTGCGGAGGAGGGATGAACCTCGCTCACGAAATCACAAACTTTATCGAGACGATTGCAGGTAAAGAACATACAGGAAAGGAATCCGTTTTCTTGTCTCCTAGATTGTCTGTCATTCTTTTGCGTTATATTTGGTTCAACGCAGCGGTTGTTTCCCTTACGGATAGCAACATTAAAATGCCCCTCAACACAATGTCCGAGGGCACTGGCGATGACATTTATAGGGACTATTTGGCCATCAGAGGCATGGTTAATAATTACAACAGTAGTCTCTCCTCTATTTCAGTCAAGGCTATTTCCGATAGGTACAATTGCGGTAGTGGAAATACTTCAACCAGTAATAAGAATGTGACCATTAAGACTCAAGGTGAATTGTTAACTGTCCTTCAACAGACTGCTAATGCCTTGTCCGCCTTTACCAACAAGGGAGGCGTGGGTGCAACCCCCGATGCTGCCAATATGGCCAACGTTATTTCCCCAATTGCTAATGCGGATGTAGTTAAGAACACCAACGTGGTTGTTTCAGGGCTAGATAGGATCACTGAGACCATCAACTTCTTTTCATTTTTGTCTCAGATCAAAACAATGAACGAGAACATTGAAGAGTATCTTAGGAGATATAGGCTAGGAGAAGGACTAGATAAGAAAGAATTGGATAATTTTGTGTATCCAAATATTGCAGCTATTGTTAAGCGAGAATTGGGGGTAAGTGGTTCCGCATTGTCCAGTAATCTCGATACTGATCGTCCAATTACTATCGACCTGAACACTGAACAGCCTTTGATCGTAAAGGCTAGCAAGGGTTATGCCTCTAACCGCTACGCTAAATTATTCAACAAAACAACAAGAACAGCAGCAGAACAAGCTCAGATGGAGCAGTATAATGCACAAATGGCTGCCAATACTATTCCTCAATTAGTAAACAGGTTGACCATCCCTGGATCCATCACGGCAGACACTGCCATCAATGTCGTTAAAGCTTTCACAGAAAATGGAGAATTTAGTAACGCAGAAACACACTTGGGGGTTATGGGTAACGCGATTAATGAAATGCAACCTCTTTTCACGGACGGATTCAACGTTGCGAACAAGCGTTTAACAGTTAACGTGGGTTCAGTTAGTAAGCTGATTCAGAATGGGTTAACCGTATCTCTCATTCTTGCTCACTCAAAGGCTAGCCCCTATGTCTTTAAGCCTCTCGTGCAAGATTTCGCTAAGCTTTTACTGGCAGTCACTGCAGAGACTTCTCTGGTTGTCTCTAGGTCCCAGAAGAGTTTCTTCCCCATTCCTCCTTCAGTATTTTCTTCAGGTGGTCTTTTCAAAATTGATAGGGAAATGTTCGATAATATGAAGACAGATTATGTAGTGGAAGTAATTAGACAGCTATCTAAGAATGCTACCGCCGCCATCGAAAGGTGCAATGATTCCGATTCAGCTGCTAGGATTGCCAAGTCAGGTGAAATTTATAACAAGGATGTTGCATCAACCACTGCAGCTCCCGGAACTTCTTCCTCCGCTTTAACCTTGTTCGCCAATAATCTCCAGAACCCTGCAAAGGTATGGTCTATGGGAGCTCTCCCCCATTTCGATATGGCCGTGGTACCAAAACTTCATGGCATTTCTCACGATCAAATGTTCCGCCTATCTACATATTATCAGGGTATTCATAAGATGGAACTTAACAGCGATTGCAAACCAGAAGAATGGGATAATTCTCTTCCTGGAAATAGGGCTAGCAAATTCTTTGGCCTTTCTTCGGTGAGCGATAACAACCGTTCATTCAATTTGGCATTGGATACTCTTTTGGCTTCACCTGCAGAGATTTGCGATCTGGTGACGAGGGAAATGGTAAAGACCAGTAACGATATTGTGCATAATATTGGATCGAATTCCAACACGGACGCGCTTCAAAAGAGCCTTCAAGTTGGTGCCTCAGCAGTAGAAAAATACGACGAGTCTACTCTTTCTACTAAAGAAACTGACGTATATTCCCTTGTTTCTGCTCTGGCTAAGAGCAAATCTCCTCTATCTTCTTCCTCATCTTTGTCGTCTGAGGGACATCTCACCTCTAAGGAGATTGATAGGACATGGAACACCCCCGCTCTTCTCGGTACCGCTAAAACTACATCCTATTCTGTTTCTGAAGACGCTCTCAATGCTCCTCTTTCAGCCGTGTTGGACTTTAGAAGGAATGTTGTGGATGCTACTAAATCTCTGTACGAAGTTGCAGCTGTTTGTAGTGTCATGAGTAAAGAGGAGGATGTGCGTTCTTCGAGTAGAAAGATTATGGGAATGGTGGAACAAGAATCGCCCGTTATGCAAGACATTGGCATTGACCGCATTGCTAGTCTTGTTAGTACAGTTGCTACCCCCAAACAGCATCGCAGATTCTTACAGACAGTAAACGATTACAAAAATTATCTCATTAGAAAAGTTGCATCGAATCCCCTTCTCTCTTCAAGATTGGGAGGAATATCCCCTACTAGTGGTAACACCGATTACAACCTTAAAGCTGTATATGATGGTGTTGTTTCTTCCTCATCATCAATGACCCCCTCGTCCATGTCTGTCTCTGACAGATTCTGGTCGGGAGTATTTTCTCAGTGCCTAGAGACTGGCCCTTCAATGTTTGCCGATGCTGGTCATGGAGGTAGTAACATGTTCCAAATCACTGCACCTAAACTTTACGGTTCTAGAGTCAACACCTACGCAGCTCTGAGCTCTGGCGTTGAGCGGCTGAGAGACTCTATTTCTTCTGCGACTCAGGAAAGAAAGAATAGGATTGCAAAGAGCATCGAAGCTCTGGAAACGTTCGTAACCGATGTGGTGGGGGGAGATACTTTGGATCAATTGCGTAAGGCCCAGAACATGTACAACAAACTGTCAGATATTACTTCCAACTCTATCTATAGTGATTTCGGAAACATTGACTGCGCTAAAATCATGAAGAATGTGACGAGCAAGAAAATGACCGCTAGACAACAATCAGATACTATTCTTAGCTCTCTCTTGCACGAACTCGCTGGCCTGGTACACAAACAACAACCTCAATTGGCTACTCAATTTGCTCTGGCGAGCCATGTTATCAAGGCAAAGTATGTCACTAATGACCTCAATAATATCCACGAGAAGGAAACATTCAGTCAATTGATGGCCGTGGCCGGTGTTGCCGATTACTATAATGTGTCGGCAGCTGCCATGTGTCAGCGTCTAGTTGCTTCCGACGTAACAATGTTCCTCGGCGGAACCATGCTCCAACAAGGCCTGTTCGTTTCATTCCTTCTTAACAACGTACTTTTCTCCCAGGTTTCTGATAATATTAAAATGAACGAATTGAACGATGAAACAAAGTCTCTTTTGGTTAAACTGGTAGGATTTTGCGGTACAGTTTCAGATGCGCTAGGATCTAGGCACGTGTCTTCAATTAGACGTGTACAGAACGAAGAGGATAAGAAATTAGACAGGAGTTTTGTTACATCACTTTATTCAGCATACAGAGATTTGAGGAAGAAGACTGAACTATACAGGGAAACTGATACTATTAACAAACTTTTCGGACATCAAAACTTTATGTCTTACGAATCTTCCATGCTCAAGAGGACTTCCTTGGTACATGACGCTGTTTCCGGCCCTAGGCCAAGAAGGTACAGCACCCTTGAGGATGTACTTGAGGCTCCTTCCACGGTTCACAAATCGTTCATGGTTTCTTACCCAGAGAGGGCAGCTGCTTCTAGGCGAGTGAAGAGGGCTGGACTCAGGGCTCTGGCTGATAACAGGATGGAATCTCTTTACGGGGAAGAAGTCTTGAACGATATGAGGTCTTCGGCGGTCTCTTCCGAAATGATGGATATAGAGTATGGTGAGGGAGGATTCATGATGATGATTAGTGATGATGAGGATGATATTGCCTTTATTGATTCCGAAGAAGAGTCTGAATCATCTACTGATTTCTCCTCATCAGATGAATATTCCGATTCATCCGATGAGTATGATTTTGATGATGATAATAATGGCCAGTCTCCTTATTCAACTACATCTTATTCGTATGATGCTCTAGACCGTCTGAATTCTGCCGCTAAGCCTCTTACTGCCATCTACGGGTGCAGGGGAGAAGGTGAAGACGATGAGGAAAATGACCTCTATGAAGAAGAACAAGAAAGGAGGAGACGTCGCTCATCAAAGATGGGGAAGATCCTTAGAGATCTTCATGAGAGTGATGATGACGACGATGACTACTTTGATGACGAATTTGATGGCGAACGTTCAATGTCAGAAACTATTGCAACCAGAAGAGCTGGCCGTATTCAATATGGTCCAGGTTTCCTATCTCATTCTAATATTCTTAACCGTCCGGCTAAAGCACGCGCTTTCTTGACACGAGGCAAGAAATTCAGGCCTTCTGCGTACGATAGATTCTTTATGGAGGATGACGATTCCCTCCTCTTCTCTGACGAATCTACCACTTCTTCTTCCTCTTCCGATTCTCCATTCTCCTCCTTCAGCAAGGGGAGAAAATGCAAGCGCCGAACAAGCGAGGACCAATGTGCCTTTGTTAAGAGAGTTGTACGTGCTTTTGTGCCCACCAGAGTAACAATGATCAATGGTCGAGTTAGCATGATCACCCCAGTGACTAGTGAAAATACAGTAGGATTCTATGAAAATTACCAGAAGGCCAACAAGAGGGAAAGGGCGCGTCTGATCGAAGAATACAAAATTGTTAAGGGTGCTTCAGCTACCTTGCCCGACGAATACGTAGAGGGTAGAGCATCTAAACAAGTGTCTCCCAGGGAACTGAGGAGGTCTCTTATCAAGGCAGCTGCTTATGTTGCCCGCACCCAAGAAAGTAACTTGAATATTATCTTTGACGCTCTCACCACAACATCAAACGCCACTCTAGTTAATGACCCATCTACTCTTTTGGGTGATACACTTTTGTTCGCCAAACAACTAGAGGCAATTACCGAGAGGAGGAATAGGCTAATGAAAGACCTAACTGAAATCTCTCCTTCACTTTTCACATCATTCGGTGATGCAAGTAAAGACACCCAAATGATGGCCGATGCCAAACAGATCGTTTCAGGAGGAAATTTCAAGTCTGCCGGCTATCTAGGTGTCCCTCTCAGAACTCTTGCTTCATGTATTAAGGGCACTAATACAGTTGATCGTCTTTTGGCTACCAAAAATAAGAACCATCTCGAATGGATGACCACAGCCGCTATTGTTTTTGCACGTTCATTCAACGATACTACTTTCCATGCACTCGAAGATACACTAAAAATGACCTCCGCTTTGACAGACATGTACAGCGCTTTCACCAACCTCGTCGGATCGGAACATTCTCAGCGTCTAAAAGTAAAGAGTACTCTTTTAGATTCTATTTTCAACACTAGGATGGCTCACACTGAAGCAGTCATGGGTCTCGTATACCCTACAGCGTTCATCAACCATGAAATGCCCTCTGATTACACACAGCGCAGAGAGATGCAATCACTCGCTCTTAACATTCTTAGGGGAGTTAATTGTAGCCAATTGCCACGAAAGGATATTGGAGACACTGCTGGCCTGTTGACCTTTATTACATCACGTAAATTTGCAGGTTATGGAGGAGAAAGGGGAGGTTTGTCTCTATACAGAATGTCCATTGTTGATGCTCTTTCTTGCCCCTCTGACAATCGGCTCAAGGGAGCAGTCTCTCTAGAGGTAGGAAAGTGGCAGGATATGGGAGAGGAAATCTTCTACAAGAGGAGCAACGATCTGGTCGATTTTTGTTCAAAGAACAATATTTCTCTGGAAAATGCCGTAGGTCCTATTGCTAGGTTTGTTCCCAATGGAACTAACATGGCTGATATTGGCATGACCGATATCATTTCTAGAACAGTCAAGGATGACGCTTCAATGATCAGGCTTAGGCGCGCAGAAGAGGGCGCTGGCGCAGCAGGAAAATTCATTACAGCCTCAGCCATGGGTAATTTGTACGGAGGTATTGATACCGTTGTGAACCTAACTGAAAAACTATACGACTCGTTCGTTCTGCTCCAAGATTCAGACTCGTTCAATACACCAACAGAAATGGCCACTGCTATTATCAACCGTATGAAGTCGAGGAAACATAAGGCTCTCAAAACACCATTCGGGGGAGATATTGCCACCTATAAGAACTTCCCATCCTCCTCTGAAGCAATTGTAGTTAGAGCCAAGGAAATGCGTAACTCTATTAGCACTATCGTGATGGACATTTCCAAGTCAAGGGGAATCAACTCGTTCTCATCCCGCAGTGGTTCTACTTTGGCCAAGATTTCCACATCTGAATTTGAAAGGATACTAGAAACATCTGCTGTTCTTTCAAATACAAAGGCCAATCTGAGAACCATTGAGAATAGACTCGCCGAACACTACAACAAACTAAAACAATTCAGCCATATTAGTAATGATGGACTTTCCGAGACACGCGCAGTCGTTGCCGTAATTGCTGAATCTTTAACCCCCGTGTATGCGGATGACACCAGCGAGAGAGGAGCATCTGTTAGTGAACTATTGACAGACAATACTCTCCTCAAATTTATTGTTCAAAATGAACTGAAAAACATTGAAGAGGCAAAACGTCACGTGACCGCCGCAATTGAAGGTTCATCCCAACTGCACGAAAAAATGTTGAGCCTGCTCGTTGCCTCAGCCGACATCAACCGTATGTCCGCCCAAAATAACCTCGAATGTAAGAAATTGACTGAAGGAAATAGTAACTTTGTACCAATGACTAACGACCAAGGTGGTACATTCATAAAGCACAAAGAAACAGGTATCTGGCTGAAGACCGATGAAGAAAATAACACCAGTTCTATCAAGGACAATGATCAGCGTAGAGTAGCTAAAACCATCCTCGCAATTGTAGAGGACAATAGAAATGCAACCATCCGTTCTCGTCTACAGTCTCTTTGCTTTGGAAAATATGCCATGAACGACATTTTTGCACTTGATGATGCCGATATTAAGAATATGGACAAACTCATTGAAAAACTAGGCGAAGCACTCGCAGAGAAGGCATCTCCTTCTAGCTCGGCCATTTCTTCTTCCTCATCATCTAACACAACATCCTCCTCTTCTTCTCCCAGTTCTTCCCCATCATCATCATCTTCCTCTTTCTCAATGGACTATTCAAACAACCTTGCCAAAACTATCCCCTACATGCCTATCGTCTTCCAAAACAAACAATCTAATGTCAATTCTTCTGACGCATCATCCTCATCACCATCATCATCTTCTTCTTCATCTGCCAATATTGATAATGTTGAGCACAAAAAAGTGGCTCTCCAACAACTTCAAACACAAGAATCTAACGATTTGAGTAACGTACTTTCTGTTACCACCAAGCACAGATTTGCGTCTCATAATCAAGCTGCAACTGTTGGCATCTTCAACGGAAGGCAACACGCAGAGACAGTTGTTGCTATACCAAATGCAAACAAGGCTAATAATAATGCCACCGTTTCCGCAGGCCAAGGAATTCTTACCCGCTTCTCAGCCCCTGAAAATGTTTCCTCCACCAGCATGCAATTGCCTCCATCATCATCATCATCATCAAATGGAGATGATAATAAGGTACCAGTAACTGTCAGGCTTAACCAGTACGCCAACTCAATCTTATCATCTATTGAAAACGCATCAGAATTTAAGGACTTGAAGGAAGCAGAAAGGAAAATCGATCTGGCCATCCAGGCAGCTTCCACCACAGAAACAAAGGAAATGGTCACCGTGTCTAAGTGCCCCTCTGCTAACCAGACTGCCATCACTGCCATCTCTCAAGCTAAATCCCTTAAGAAAAGTGCCCTCGAATTATTGGAAAGAGTTATCAAGGCAGTCGAGGTTTACACCCCAGATTCATCTATTGCAGCCGTTTCTCTTCCCGTTAATGGAGATTCTATGGTTTCTTCTTCCTCGGGATCAGGATCTGCTCCCTCTTCATCATCCTCCTCCTCATCCTCATCCTCTTCCTCTAATGTGACAGACTATTTCAACTATGCTTACGGAAAATTGAAGAACATTGATGAAAATACTGAAGAAGGGGCAGAAACTGTCCAGAAAAACATGGTCGAACAAGATGCTGCCGTTCGCATCCCTCTTCTAGTATCATATGCTCCATTCAGCGAAATGATGAGACGTGCTATTGACAAGTTGAACGAATACTACCAACTGATTGATGCCATCAAAACAAAGATCGTGTCAGACACTAAACAGGCTTCCTCATGGGCCATCAAGGAAACGGACAAGGAGCTTGATATGGACAAAGAACAGGTGATTTCAAAGATTAATAACTTGCAACAAAACTTTTCAAACGAATCAGACAAGATAAAGATGGCTATTAGTGTTTTGGACAACAAAAGGAACGAATTAGAGCTTCAGAACAACAAAACTAGGAGCTTTATTGAAACTACAAAGAGCCGTATCGAGGCTGGTGGAGGAGATGTAGCAAACTTCAAGGAGATTATCGATTACGAAAACACATCTGAAAATGACAACAATCTCTTCCAGAGCCTGAAAGCATTCGCTGCTGATAACTCGGGGACAGTTTACACCCCCACTGACATGAGCAATGGAAGAGACACAAAATCAGACAGTAAATTTGTCGACATGTACAACAAACAGATTCTCGAGGGAGGAATCAAACTCATCAATGAGGGACAAAATACTGTAAAGGTAGACTTTTCAAAGGCTTTGGAGGCTTTCCCTAGACAATCCAACGGTGCTTCAGAGCCTGTATCTTCTTCAGTTGTGGAGAGGAGACAGCGAGAACGTCTTCAGGCTGTCGAGATGTTTATGGCAATAATGATGGAGCGCACCGAGAGTCTGAGGAAGAGGTTGGCAGATTCGGCTGCTCAGTGGAATACTGTTAATAATGTAGAAGAAACTGTTAATAGTGGTATGGTTAACATCAAGAGTGAAAGGCTCACAGAGATTAGGAATCAAGCACAAATCGCTGAAAGCACTGCACTAAACTCCATCAACGACGAGATTGTAGAGTCTCCTCTCACCCTCTCTTTGGGAGCACGAGTCGACCAGCTCTTGATCAAGGTAGATAGAGTAGGAAGTATCCAACAGCAGCAACAGCAACAGCAGCAACAGCAGCAGCTTCCCAAATTGACAGCTACAGAACAGAGAAAGGAACAACAATACGCTGCAGATAGGGTTGTTTACGATCCTTCATACACCTGCTTCCTGCAACCTCTTCACGAGACAATTAAACGTATTTCTTCTGTCTATAATTCAAAGAACAAGGGTCCTCTCAGTAACACACGTGGTGTTCCCACTAGCGATGCCGACTTGCAACTGATGACCATCACTGACTTGTCTAGGTCTGTACTCGACTCTTCTTCCACTTCCTCCAAGAAAATGCTGTACGAAAATGTTCCCTCATCAATTGTTCCTGGACTCTGCCAGCAATGCGCAATGATGATCACCAACGTCCACGAAGCCACTCATACTTCTCCTCATTCATTCAATTTCGAGAACAAAAGATCCCTGAAGCAGCTGACAGAAATGTTGAACGCTGCCACTTCATCCAGTGACGGTCCTGCCGTGAGACACGATGTACTAACAATGTTAGAGTCCAACAATGGTTACGTCAAAGATTTTGGATTCACTCACCGCCAAAAGGTTGCGTGTATCACCCCTGTTAATACACTTCTGGGAGGTACTTTCAGTGGAAATGTTGCACCTAATACTGTTATCCTTCCTACTTCTGAGTTGTTTAACTGCCCAGGAGTTGAAAATGACAAATTTAGATCCATGGTTAACAGGACAACCGACAAGAATGTGGCTGACGCACCCAAGTCATCTGCAAGCATCGTGGAGACTCTTGCTCGCACGTCTCCCAACGCCGAGCACCTTTACTTCCCCTTCAAGGACCAGAGGCGACACTTCAACTCCATCACCGACGCCATCATTTCTGGTATGAGCGGCGAATCTTCATCTCAATTGAACACTACTTGTGATCAAAATCTGGTAAACATTGATCAAACTACTGGCTTCCCAGTGTTTACAGGAAGAAAGCAGGGCGAAAGAAGGATTGTGCACACTGAAAACACTATGGAAGGAGCTCGCAAGGACAAGAACAGTGGCATCCCTTCATGTACAAAGGACCGTCAAACTTATATCGATATGGGCACAAAATTCATGGTTGCTCCAGGCTCTCTTCTGAATGCTAACAAGGAAGAAACTCTCCGTCTAAACAGGCTTTCAGACATTAACAACGTGAGACATTATGGCACTGATGTTCATGTGGCAGGCGCAAACTCTGCATGGAGAATTGGTGAGGTGGTGAGAGCCGCCTCCTCATTCCCTGACGGAGATAAGGAATCGGCTATGAAAAAGATGCTTCTTCTAGGATCTGTATCTGCCATCTCTGCTCAAAAATCTGCCAGTCACATTAACGATCCTACTGCTTTGTTGAGCACCAACACGTCTATCCAGAATCTGGTCAAGGAAGCTTTCCCAGACCCTGTTTGTTCCTCTAATTACTTGGGGTCTGCTGAATCTACGTTCGCCACTCAACTCGCCTACCGCCAGCGCCTGTTCCCTAACGGAGATGACGAAAACGTTACAACCGTTTCAAATATCTGCCCTATGGATTTGATGGGAAGTACAAAGCGCTACAATGACGCTTTCAACAACATCTTTGGCTCTAAAATGACATCTACTAACAAAAAGGGGTCAAATTGTGAAAATCTACTGAAATCTGCCATGTCTAACGTTCCTGCTATCAACACTGCCTTTGGAGCCTTTGAAGAAGCTTCATCTTCTGTCAGGAATAGGCTTTCTCCCCTTTATGAAGACAGCACCAAATATTCGTCCAACCAACTTGCTGTACAGGCCATGACCGATACTGCTGTGGATGCTTTGTCCGCTGTTTCTACTGTTGTCGGTCGCCAGAATGGCAGAAATACTCTTCTTTCTCTCCCTACTTCTATTACTTCTATCGCAACCAGTGGCCGTCCATCACTCTCTTATTCTTCGGACATGAAATCTAACCTCATCAAGACAATTTCCCGCATCAATAGAGACGCTAGCCTCCTGTCAATGGGAGACAGCCAAGTAGCTGCAGGTTCTTCCTTCTTTAACTCTTTCCTTCGTTCTTCTTCCATCCCTGTCACCACCAGCCAGGATGGAAATGTTGCAGCAGCGGAAATTGTTCTGGGGACTATTCTCGACAAGACTGTGGAGATCAACAAGAGATTCGAGATGCTTGGAGGAGGAAAAATGGTCGCCGGGAGTCCTGAAGCTCGTGCCATCCAGCGCAATACAATGTCCTCTATTCTCCAGATGAACGAAAATGAACTCGCTCGTGACTTGTGCGAAATTGAAAATAAAATTGAGACTAGGCAACTGAGGGATGCTTTCCAGGATTTGAAGAGGTCTATGCTGATGACTCCAGGAGGCGTGGGAGCCATTTCTTCTGGAGCAAGTACCAACAATGTTCCCCTTTCTCTTCTCATGTCACGTGTCGATGCATCCAGCGGTCTTCTGATGAACAACAACAGTGCCAATGTAATGGAAGCTGTGGATAGTTTCAATACTACTCCTTTGCTCGTTAGGCACATGATGTTGGATAGTGGAAAGTCCCCCGTTCCCATGGCCAAGGAAATTAGGAGCATGCTGACCCAACCAAGAGCTCTCACCGCCCGCGCTCTACTGAGCGAATCTTCCCCTCTTCTCACTGAAATCTGCCTCTACAACACCCGCGACACTCAACCAGAAAGGGCAGTCGACAGACTACTAACTTCAGCCTATCTAGTAAAACAAGCTAAAAGATTCGACGGAGTTGACCCAGCCTTCCCTGCCGCCCTCACCTGCGCTTCTCACCTCATGCTTTCTTCCATGGATTCCCATACAAAGTCATCTTTCATGGACAACATCAAATTGCACATGACTGATACTCAATGCTTCTTCAAGAACATTGAACGATTTGAGAAATTCTTGGGAAGATATGGGGACGAATACGCCATGTCCCACAAGCAAAATTGTAACTGCCCCTTCCATCTCCACCACACTTTTACTCCCTCAGATAACGAGCATCTGGTATCCTCTTTCGCATTCGCCCGCCCAGAAGTCTCCATGGAAGAAATTAGAGCCACACCCTATCAGGCCAACAAGCTTATTAGTGACAAACATTACGTGATGAACATGTCCAAGATCGATTCTAGAGTAACAGGATCTTCCCTCCTTAAGAAGGTTAGCGAATGGACTGAAATGAGAATGAACTCCAACTTTAATGGAACATTTGAACCATCAAGACTCGCCCTCTCCAACTCTGGCATGACAACGGCAGGAGTCAACCTCGACGTTATTGTCAAACCAAATAATGCAAGAAGTGTACTAGGAATATTGGAATGTCATCGCCAGCACGTGTGCACCGCCGACGCCAAGGGAACTGTCGCTTCAGCCATGCCAGCCGTCTTCCAGGCAACCGATGGAAACGGTAACGAATCTGAACTGATCCAGAATGCTCTGCCAAGGAACAGATACATCCAAAAGAGCACAATGAACGCTCAAACTGTCGTGTTTGCTAATGTTTTGGAACAACTTATCGCCGATCTTGGAAAGGTTATCGTGAACGAACTGGCCGGCACCATCGCTGAATCTGTACCAGAAAGCGTATATGAAAACACCAAGGAAATGATTGATAGACTAGGCTCTGACGACCTCTTCAAATCTAATAATAATGGAGGAGTAGAATCAATGGATTATGAAGATAGCGAAACAACATCCAACAATGGTCCCGTCCTCATCTCAGAAGCCATGAAGAATGCCGTCTATCACACACTAATTTCCGGCAAGGCAGCTCGCCCGGAAAATGTACCATTCGCCTCATGCGCCAGCGGCCCTCTCGCCTTTGATTTCCTTCTGTCAAAGGGAGATACATTCGAAGAAAAGAACGCCGAACAAGGTGCAGCAGCTGCCGTATCCTCTACCTATTCTTCCTCTTCTAACACTACTCTTCGTAAGCATTTGGCTCGAGTTTTCGAAGCCATCTCTAAGCAAGTAACTGATGCTGAATTCAAGGATATCCTCAACGATATCGAACGTAATATTTCTTCTGACTATACTAACTGTCCACCAAATACTAACCAAAATGCCTTTGCTCTAGCTATCAAGAGAGAATTCAGCAGAATTGTTTCCTTCTTAACCATTCTTCGTAAGAACATTACACCCGCATTAGTCGACCCTAAAGGCGCGTTACACGAGAAAGTAGCCATCTATTTGACCCTTCTTTCAACCAAATCAAAACTAGAAAACTTTTTCCAATACGGTCTCAGTAATTCGTCCTCAGTTGATCTTAGCCATCTAAAACCCATTAATTGTAGCAACAATGTCAAGAATATTGAAGACACATTCATGTACAGAAATGTCCACCCTATTCTTATTATGGCCCTCCCAGAAAATTTCACAGCTCTCTTGCAACAGGAACAAATGGACCCCGATACTGCCATTGAAAGCAGACGCTCCCTTACCACCTTCCTTAATCATCCCAACACTGCTTCAATGGCGAACGGTGCAAGAGCCGCTGTGGGTGCAGGAGGAGGAAACCCAATGGGCTTGTATCTTTCTTCCCACATTCTTCACGAGTCTACCGTCACAACATCAAACCCCGTCACAGACACCACAGAAAACGTCAACTATCATTCCTCTGTTACACAAGATCCTGTTATGGTAGTGAACCCCTTCAAGGATTCTGCTAGGTTGATCGTTAACAACAACAATACTGGAATTGATGTCTTGAATGATAAGTCGTGCAACTACTTGCAAGTATCCATGCCATCTGAATCATCTGGCCTCGTCACCAATACTGGATGCTCTTCTTCTTCTTCCTCATCTTCGTCTGATACCTTCAAGTACGTCAGGAGAGACAATACGCCTGTGAATCTTCCCCGTGTCACACCAGCCGTTCTCTGTTCTGATGCTTCCTCTAATCTCTTGGACGTGTTCTCCAGGGCAGATATTGTCCTCGAAAACATGAACGTGAGATTTGGTTTCATGCCCGAGATTATTGCTGCCGTCTCCAAATTCAAGGGGCTGACCAAGGAAGAGGTTATTAAGCAAATGGTTTCTCAGAACAACATCAACAACAACAGCAACAACAACAACGGAAATGGGAAGAAAACAACCGTCGATCCAGTCACTGGGGATATTGTTATCACCAATGCCACATTCCCCGACACTCGTCCTCTATACACTGCAGCAAATGGAGGAACATCATCATTCAAATGGGGAGATATCAACGACAGAAAAATGCACGCCAAGGCTTTCCCCACCTTCTTTATTGGTAACCCAACCGCCGCCGCAACAGCTAACGGAGTGCCTCTTACATCTGAGGGAATTTCCCTCACTGAAGAAAAACGCAAGAAAATCGCAGGCATCTCTGAAGGATCAATTGGCACGGGGGCTCTGCGTGCAGCCGCCAACACCCGCCTCTCATCCGACATGGAACCTGTCATGAAGGGATGGAACAACATTGTTCAGCTTCAACAAACATTCAAGAAAGCTTCAGATAAACTCACTCATCTTTTGAGATCGGGAGGAATTCCACCCAGAAGCCAAGAAACAAACGCTATTATTAACAAGATGCACGACAGCTTCAAGACATTGGAGGAATGTCGTAGGGTGATCCAAGACGAGGCTGCTCTGCTCGTTGCCACCAGCGATCTTTTGACCGGTGGCTACGGAGGAGATGCTGCTCTGGCCATGGTTTCTCCAGTACGTCCAGAAATGACTGGTCTTATTGGTGCAATCTCCGCGCCAGTTAGAGGTATTAGCCACTTGTTGAAACTGGGAGGTGTTTCTGCTGCTAACGCAGCTATCCGCAAGCGCCTCAACCTACCTACATCCAACGGGAAAACACTACCAGAACATGGAATCGTACACAAATCAGCCAAGACACTTTTGCTTGATTCAGACTCTATTAGCAACCTATACAACACTGATCTTCAAGACGTTGTCTCTAACGCTAGGGATAACAACAATTTGGGAAGAATTATGCAATCTTTGGGACTTAAGGGGAATAATGCAGGGGATTTGGTTTATTCTGCTAGACAACTGACGGACCTTATTACTGTACCAGAATATGGAAACAATCGCGATCTTACCAAGCGTCAAGCTATCCTTAAAATGCTCATTTCTAACCCTGAAATTCTAGAAAATGTTGCAGATACCATTTACCTTACAACAGGTAAAAATGCTCTCGCACCGGTATCTGCTCAGGAAATGGCTTGTGCGTCTCTGACAGTCGGAGGAAGTGGAGGAGGAAAACTGTCATCAGACGACAATGTTCAATCCCTGAACCGCCTTTATTTTCGGGTCTAG

SEQ ID NO: 4 - protein, 1684 aa, Artificial Sequence
  Whispovirus wssv. >P5MICT164891 (VP180)
MAYIDQGAFGAKSVMQQQYLLPPSNRLSKQQPPLASSSLQPSSSNKPRSTSRVTDIFVVITCVVLIAAFISNSFSVTKNVVKLSKEQTEKILEKDLPDKVYKLFENLKDGTFGIGEDEEEEREEREEGEEELETKNIRLKRKWKEMTEQGDQGIKVRKLHGPRGERGETGPAGAVGPAGPQGERGAIGPAGKDGAVGPAGPQGERGAIGPAGKDGAVGPQGPPGERGENGRPGRDGAVGPQGERGAIGPAGKDGAVGPQGERGAIGPAGKDGAVGPAGPQGERGENGRPGRDGAVGPAGPPGERGAIGPAGRDGAVGPAGPPGERGATGIPGRDGVDGSVGPQGERGEIGRPGRDGAVGPAGPQGRRGATGRAGKDGAVGPAGPQGEKGEAGKDGSIGPQGIQGPRGETGPPGRDGTAAERGERGFPGPPGETGPPGKDGVDGSEGPQGKRGETGPVGPRGEPGLAGLPGRDGAIGPAGPPGERGATGLPGRNGVDGSIGPQGRRGATGRAGKDGAVGPAGPPGERGATGIPGRDGVDGSVGPPGERGETGPAGRDGSVGPAGPHGERGENGRPGRDGATGPIGPAGPQGEKGENGRPGRDGATGPIGPRGETGAMGKNGVDGSMGPQGRRGATGRAGKDGAVGPAGPPGERGETGPAGRDGSVGPAGPQGETGLTGSPGRDGATGPIGPAGPQGEKGENGRPGRDGATGPIGPAGPQGEKGENGRPGRDGATGPIGPAGPQGETGLTGRPGRDGATGPIGPRGETGAMGKNGVDGSTGPQGRRGATGRAGKDGAVGPAGPPGERGENGRPGRDGATGPIGPAGPQGETGLAGLPGRDGAIGPQGEKGENGRPGKDGATGPMGPPGERGETGPIGPAGPQGATGLPGRDGVDGSVGPQGKRGLIGRTGRDGAIGPVGPAGPKGETGLAGLPGIDGKDGSVGPQGAIGPIGPRGERGETGRPGRDGEDGSTGPMGPQGLRGATGAPGPQGERGLKGRPGKDGETGPPGRQGRDGIMGPRGLRGEKGAPGNDGLEGPEGRDGAPGPAGPIGPQGIRGLKGIQGRPGRDGEMGPAGKDGIEGPRGQDGTTGAKGPRGLRGFQGRTGETGAQGSRGEKGDRGLTGPQGRDGPPGEEGPQGLRGERGAPGPRGPRGIRGRSGPQGSNGVQGPRGPRGTKGRTGIQGLTGIEGPRGPRGIQGKEGRMGKIGHRGEKGDKGDRGEQGIAGADGEKGPRGLRGIRGPIGAPGKPGTEGVRGPRGVRGVPGYPGAQGELGPQGPTGPQGPAGPQGPMGRTGDTGPMGPPGAVGPRGEKGGRGRKGKNGPKGADGKDAVNIIQKYSITHARAEIMWEGNEIGEAYIGRSYGTDTIPVMIENRIGMTNEDKKNEYCIQVMTMHSITTRGRTSGVFVVSNKTDYILLVTLLMPESVSCRTDVSTNARSERVNAVRERESKSYRFIRPSDQSIGTHSRSKIAVVMYPDASMSYSVDTLDADVARRETTSVLLLAETIHGEKDRGFYADRGTVGRLMVPPTEEELLVLQADPDITPTIADPITVAEVGNPVVRIKTPSCDELNKFMRFSTNFSFLKYVKRFMAQRASSNSRNDMSAFLLDLIFEKLIEFLLSTGWNREALGGTTGAILMIRTATCRLAQSYYPLPETVGMDFLQTPGFDYNKSFPNNERYIYEFQATM

SEQ ID NO: 5 - protein, 5055 aa, Artificial Sequence
  Whispovirus wssv. >P5MICG164891 (VP180)
ATGGCGTACATTGACCAAGGGGCGTTTGGAGCCAAATCTGTGATGCAGCAACAATACCTTCTTCCACCCTCTAATAGGCTCTCCAAACAACAACCTCCACTGGCATCATCTTCTCTTCAACCTTCCTCTTCTAATAAACCTAGGAGTACATCAAGAGTAACAGACATATTTGTTGTGATAACTTGTGTTGTTTTAATTGCTGCTTTTATAAGCAACTCATTTAGTGTTACAAAAAATGTGGTAAAACTTTCTAAAGAACAAACCGAGAAAATACTAGAAAAAGATTTGCCTGATAAGGTGTACAAATTGTTTGAAAATTTAAAGGATGGAACATTTGGTATAGGGGAAGATGAGGAGGAAGAAAGGGAGGAGAGGGAGGAAGGGGAGGAAGAGCTTGAAACAAAAAACATAAGACTTAAAAGAAAGTGGAAAGAAATGACTGAACAAGGGGATCAAGGAATAAAAGTAAGGAAATTACATGGCCCGAGAGGAGAAAGAGGAGAAACTGGTCCAGCAGGAGCAGTTGGCCCTGCAGGCCCTCAAGGAGAAAGAGGAGCAATTGGACCGGCAGGAAAGGATGGAGCAGTTGGCCCTGCAGGCCCTCAAGGAGAAAGAGGAGCAATTGGACCGGCAGGAAAGGATGGAGCAGTTGGCCCTCAAGGCCCTCCAGGAGAAAGAGGAGAAAATGGACGCCCAGGAAGAGATGGAGCAGTTGGCCCTCAAGGAGAAAGAGGAGCAATTGGACCGGCAGGAAAGGATGGAGCAGTTGGCCCTCAAGGAGAAAGAGGAGCAATTGGACCGGCAGGAAAGGATGGAGCAGTTGGCCCTGCAGGCCCTCAAGGAGAAAGAGGAGAAAATGGACGCCCAGGAAGAGATGGAGCAGTTGGCCCTGCAGGCCCTCCAGGAGAAAGAGGAGCAATTGGACCGGCAGGAAGAGATGGAGCAGTTGGCCCTGCAGGCCCTCCAGGAGAAAGAGGAGCAACAGGTATACCAGGAAGGGATGGCGTGGACGGTTCTGTGGGCCCTCAAGGAGAAAGAGGAGAAATTGGACGCCCAGGAAGAGATGGAGCAGTTGGCCCTGCAGGCCCTCAAGGAAGAAGAGGAGCAACAGGACGCGCAGGAAAGGATGGTGCAGTTGGTCCTGCAGGCCCTCAAGGAGAAAAAGGAGAAGCTGGTAAGGACGGTTCTATAGGGCCTCAAGGAATACAAGGCCCAAGAGGAGAGACTGGACCACCGGGAAGGGACGGCACTGCAGCAGAAAGAGGAGAAAGAGGCTTCCCAGGACCACCAGGCGAAACTGGACCACCAGGAAAGGATGGTGTGGATGGTTCTGAGGGCCCTCAAGGGAAAAGAGGAGAAACAGGACCCGTTGGACCTAGGGGTGAACCAGGTCTAGCTGGCCTCCCAGGAAGAGATGGAGCAATTGGCCCTGCAGGCCCTCCAGGAGAAAGAGGAGCAACTGGTCTACCAGGAAGGAATGGTGTGGATGGTTCTATCGGCCCCCAAGGAAGAAGAGGAGCAACAGGCCGCGCAGGAAAGGATGGGGCAGTTGGCCCTGCAGGCCCTCCAGGAGAAAGAGGAGCAACAGGTATACCAGGAAGGGATGGTGTGGACGGTTCTGTGGGCCCTCCAGGAGAAAGAGGAGAAACTGGACCAGCAGGAAGGGACGGTTCAGTTGGCCCTGCTGGCCCTCATGGAGAAAGAGGAGAAAATGGACGCCCAGGAAGAGATGGGGCAACTGGCCCTATAGGTCCTGCTGGTCCTCAAGGAGAAAAAGGAGAAAATGGACGCCCAGGAAGAGATGGAGCAACTGGCCCTATAGGCCCTAGAGGAGAAACTGGTGCAATGGGAAAGAATGGCGTGGACGGTTCTATGGGTCCTCAAGGAAGAAGAGGAGCAACAGGCCGCGCAGGAAAGGATGGGGCAGTTGGCCCTGCTGGCCCTCCAGGAGAAAGAGGAGAAACTGGACCAGCAGGAAGGGACGGTTCAGTTGGCCCTGCTGGCCCTCAAGGAGAAACAGGATTAACTGGCAGCCCAGGAAGAGATGGAGCAACTGGCCCTATAGGTCCTGCTGGCCCTCAAGGAGAAAAAGGAGAAAATGGACGCCCAGGAAGAGATGGAGCAACTGGCCCTATAGGTCCTGCTGGCCCTCAAGGAGAAAAAGGAGAAAATGGACGCCCAGGAAGAGATGGAGCAACTGGCCCTATAGGTCCTGCTGGCCCTCAAGGAGAAACAGGATTAACTGGACGCCCAGGAAGAGATGGAGCAACTGGCCCTATAGGTCCTAGAGGAGAAACTGGTGCAATGGGAAAGAATGGTGTGGACGGTTCTACGGGTCCTCAAGGAAGAAGAGGAGCAACAGGCCGCGCAGGAAAGGATGGAGCAGTTGGCCCTGCTGGCCCTCCAGGAGAAAGAGGAGAAAATGGACGCCCAGGAAGAGATGGAGCAACTGGCCCTATAGGTCCTGCTGGCCCTCAAGGAGAAACAGGATTAGCTGGGCTGCCAGGAAGAGATGGAGCAATTGGTCCTCAAGGAGAAAAGGGAGAAAATGGACGCCCAGGAAAGGATGGGGCAACTGGCCCTATGGGTCCTCCAGGAGAAAGGGGAGAGACTGGTCCTATAGGTCCTGCTGGCCCTCAAGGAGCAACTGGTCTTCCAGGAAGGGATGGTGTGGATGGTTCTGTTGGCCCTCAAGGAAAAAGAGGATTAATAGGGCGCACAGGAAGGGATGGGGCAATTGGCCCTGTAGGTCCTGCAGGCCCTAAAGGAGAAACAGGATTAGCTGGCCTGCCAGGGATAGATGGAAAGGACGGTTCCGTGGGTCCTCAAGGAGCAATTGGACCTATAGGCCCACGAGGAGAAAGAGGAGAAACTGGACGACCAGGAAGGGACGGTGAGGATGGTTCCACAGGCCCTATGGGCCCCCAAGGACTAAGAGGAGCTACGGGAGCTCCAGGACCGCAAGGAGAAAGAGGATTAAAGGGACGGCCAGGAAAAGATGGTGAAACAGGTCCTCCAGGGCGACAAGGAAGGGATGGAATAATGGGTCCTAGGGGTCTTCGAGGAGAAAAAGGAGCACCTGGTAATGATGGTCTAGAGGGACCTGAAGGAAGAGATGGTGCACCTGGTCCCGCTGGCCCTATTGGACCTCAAGGAATAAGAGGATTAAAAGGTATCCAGGGACGACCAGGAAGAGACGGAGAAATGGGACCAGCCGGCAAGGACGGAATAGAAGGCCCTAGAGGTCAAGATGGAACAACTGGCGCTAAAGGACCTAGAGGATTAAGAGGTTTTCAAGGAAGAACAGGAGAAACTGGTGCACAAGGATCTAGAGGAGAAAAAGGCGATAGAGGGCTAACAGGCCCTCAAGGAAGAGACGGTCCACCCGGTGAAGAAGGTCCTCAAGGTCTTAGAGGAGAAAGGGGAGCACCTGGCCCTAGAGGTCCTAGAGGTATTCGTGGCCGTTCAGGACCTCAAGGAAGTAACGGCGTGCAAGGACCTCGAGGTCCCCGAGGAACAAAAGGAAGAACAGGAATACAAGGCCTCACTGGCATAGAAGGTCCTCGAGGTCCTAGAGGTATACAAGGAAAGGAAGGAAGAATGGGGAAAATTGGACATCGAGGAGAAAAGGGTGATAAAGGAGACCGTGGAGAACAAGGCATCGCTGGAGCAGACGGGGAAAAAGGTCCAAGAGGTTTACGAGGAATTCGAGGCCCTATTGGTGCTCCTGGTAAGCCTGGCACGGAAGGGGTTAGAGGTCCTAGAGGGGTGAGAGGTGTTCCTGGCTATCCTGGCGCACAAGGGGAATTAGGTCCCCAAGGACCAACAGGTCCTCAAGGGCCAGCAGGTCCTCAAGGGCCGATGGGGCGTACAGGAGATACTGGTCCCATGGGCCCTCCTGGAGCAGTGGGACCAAGAGGAGAGAAAGGAGGTAGAGGAAGAAAGGGAAAAAATGGCCCTAAAGGAGCGGACGGAAAAGATGCCGTAAATATCATACAAAAATATTCAATCACCCATGCTCGTGCAGAGATAATGTGGGAAGGAAATGAAATCGGAGAAGCATACATTGGAAGATCTTATGGAACTGATACAATCCCTGTGATGATAGAAAATAGAATAGGGATGACAAATGAGGACAAAAAAAACGAATATTGTATACAAGTAATGACAATGCACTCAATAACAACTAGAGGAAGAACATCGGGTGTTTTTGTGGTAAGCAATAAGACAGATTATATCCTTTTAGTTACTTTACTGATGCCAGAAAGTGTTTCCTGTAGAACAGATGTCAGTACAAATGCGAGGTCAGAGAGGGTGAATGCTGTTAGAGAAAGAGAAAGCAAATCGTACAGATTTATTAGGCCGTCTGACCAATCTATAGGTACTCATTCACGTTCAAAAATTGCCGTGGTAATGTATCCAGACGCAAGCATGAGTTACTCAGTTGATACATTAGACGCTGATGTGGCGCGAAGAGAAACAACGTCTGTGCTTTTATTAGCAGAAACCATACACGGGGAAAAAGATAGAGGTTTCTATGCTGATAGAGGAACTGTAGGGAGGTTGATGGTACCTCCCACTGAAGAAGAGTTATTGGTATTGCAAGCGGATCCAGACATCACCCCAACAATCGCAGACCCGATTACAGTAGCAGAAGTTGGAAACCCTGTCGTGAGGATAAAAACTCCTTCATGTGATGAGTTGAATAAATTCATGAGATTCTCTACTAATTTCTCATTTTTAAAATACGTCAAACGGTTTATGGCGCAGAGAGCTTCATCTAATAGTAGGAATGATATGTCCGCTTTCTTATTAGATTTGATTTTTGAAAAATTGATAGAGTTTTTATTATCAACAGGATGGAATAGAGAAGCTCTGGGAGGAACTACTGGGGCTATTCTTATGATCAGGACGGCAACTTGTCGTCTAGCGCAATCTTATTACCCCCTCCCTGAAACCGTTGGTATGGACTTTTTGCAAACACCTGGGTTTGACTACAATAAATCTTTCCCTAACAATGAAAGGTATATATATGAATTTCAAGCTACAATGTAA

SEQ ID NO: 6 - protein, 1218 aa, Artificial Sequence
  Whispovirus wssv. >P5MICT165161 (VP136A)
METTMDNVVQNNDVTKPTPDVATVTTATEKRQSCKEKKDQLKAECPQVLRALKLSNTLKANFGKSMSAIFAQHLVDMTNAKHFKDPKTKKILELDGSSSSDSEEEEETSSSSKRKRGSGARSASSKKEKCPNTIKNWLNDAQGVFRQFADIIINLPSFDDLRDEVKDEQTELKTIYDLYRQDMEKVVEEVLGRQDLFDHKSEIAKGLARFDTHVSLLPSDRSAVLDSSISKELEKNSKGPNSNIFDTLNTLKEEIKELLCHHVKYLLQNLTPEDANFVFNSSVKYVKKSYQYYIQTSEMESDEFKSLLTGVNIKILEKIISSDNNVATPYKHITNPRNIISSLQKVRETKPVSKDYPFRVDTARDIVLLPETGGISDLPIKPVTLLQLVSYINALFSLERRNVFTDGFFNAACVLISQCLTNANLLSNDFPKPIELAANVTRHNLLSMKMLQEGSSSEKKSKKKEKKKDKKKGGGGGDDSDSETDSSSSSSSSSSSSSSSSSEDEEEEKGEAVEKGKKTKRKTKKKPSKDDDLDTISKLILKTGGYFHDTSELGNKIRNLIDKDDFAGVAQYAVTITEMQSTPMNQRLVSSLLDLIMRLKEQVKYSVDTESTSSTAKSNNALDSAKLTSQQVVTMMVDSGAELARLAAFFFVVVDNTVVNRHEAFILTSKLLPSNENRGLKTVVESFFKNLTISNKVSTSNEEMMSVMPFEDEQQQQQCPQHEQQPDLKRVVGEVFLEMGKSIVNSFPSNKSVQLTADAFKQNYSPMGRRINLAAKIKTAISIGSNISPNILFSNLPESVGNNTVTGLRLTNLLKNISQSAQANNIIKNANTLVNNTMDQQNSAAMSILLFPPTSKETSIFPGNDPSSIKLQDMTTMSNLARGFYSIAEGCIGVVRSREFDEGGVKAYTLLVDSNTMDMAVNFAAQSLEKSMSEALTNNANMNPSNVLEGGSFVDGALSYMFEKNGSDCEPTPLAKYTMKDVSNRYLKKFNNDKNTQDLYKNRAERALVEQVTNKPTSVVHSQLANAMGVAVIGAASIKLMEAEAAESEMRAANYQATSKSTNAINITNTIGMIRNTTHLCTTIAVSAAADMSKLANNHFMSVLNTANNSHSSRRGDRSSLMLQQQQPTHSAFLEQTRGRGGGVLGSGTEQTKDHVERMKRDWILNMISPEDKNTTTTTPSNAGRTLGYGSNITGINTIKQDDKSMMDKLSEMSSFRT

SEQ ID NO: 7 - protein, 3657 aa, Artificial Sequence
  Whispovirus wssv. >P5MICG165161 (VP136A)
ATGGAGACAACTATGGATAATGTCGTTCAGAATAACGACGTAACAAAACCAACACCAGATGTTGCTACTGTTACAACAGCAACTGAGAAACGTCAGTCATGCAAAGAGAAAAAGGATCAACTTAAGGCCGAATGTCCTCAAGTACTGAGAGCACTAAAATTGTCCAATACTTTAAAGGCAAATTTTGGAAAATCCATGTCGGCTATTTTTGCTCAACATTTAGTGGACATGACAAACGCTAAACACTTTAAGGACCCAAAGACAAAGAAGATTTTAGAACTGGATGGAAGTAGTAGCAGTGACAGTGAAGAAGAGGAAGAAACTAGTTCTTCATCCAAACGGAAAAGAGGTAGTGGTGCTAGAAGTGCTTCTTCAAAGAAAGAAAAATGCCCCAATACTATCAAAAATTGGCTCAATGATGCTCAAGGTGTATTCCGCCAGTTTGCAGATATCATCATTAATCTTCCCTCTTTTGATGATCTTAGAGACGAAGTAAAGGATGAACAAACTGAGCTAAAGACCATATATGACTTGTATAGACAGGACATGGAAAAGGTGGTGGAAGAAGTTTTAGGGCGCCAAGACCTGTTTGATCACAAGTCAGAAATAGCCAAAGGTTTGGCCCGTTTCGATACCCACGTCTCGTTGCTCCCTTCGGATAGGTCGGCTGTTCTAGACTCGTCCATATCCAAAGAGTTGGAAAAAAATAGCAAGGGCCCGAACAGTAATATTTTTGACACACTAAACACACTCAAGGAAGAAATCAAAGAACTTTTATGTCATCATGTCAAATATTTATTGCAAAATCTTACACCGGAGGATGCAAATTTTGTGTTCAATAGTTCTGTAAAGTATGTAAAGAAATCATATCAATACTACATACAAACATCAGAGATGGAAAGTGATGAATTTAAGTCCCTTCTCACTGGAGTCAACATTAAAATATTGGAGAAGATAATCTCGTCCGATAATAATGTTGCTACTCCTTACAAACACATCACTAATCCCAGGAACATTATTTCGTCTTTACAAAAAGTACGTGAAACTAAACCTGTTTCAAAGGATTATCCGTTCAGAGTGGATACGGCCAGAGATATTGTACTACTTCCAGAGACGGGTGGCATTTCTGATCTCCCTATCAAGCCCGTTACATTATTGCAGTTGGTGTCCTACATCAACGCTCTCTTTTCCCTCGAGCGCCGAAATGTTTTCACCGACGGCTTTTTTAATGCAGCGTGCGTCCTAATTTCCCAGTGCCTAACGAATGCGAACCTATTATCTAACGACTTTCCTAAACCCATTGAACTGGCAGCTAATGTTACTCGCCATAATCTTCTGAGTATGAAAATGCTTCAAGAAGGTTCATCCAGTGAAAAGAAGAGTAAAAAGAAGGAGAAAAAGAAGGATAAAAAGAAGGGCGGTGGTGGTGGTGACGATTCTGATTCAGAAACAGATTCTTCCTCATCATCATCATCTTCTTCTTCTTCATCCTCCTCCTCCTCATCCGAAGACGAAGAAGAAGAAAAAGGAGAAGCAGTAGAAAAAGGCAAGAAAACTAAACGCAAAACAAAAAAGAAACCATCAAAGGACGACGATTTAGATACAATTAGTAAACTGATTCTAAAAACAGGAGGTTACTTCCACGACACGAGTGAACTCGGCAATAAAATTAGAAATTTAATAGACAAGGATGATTTTGCGGGCGTAGCCCAATATGCAGTAACAATCACTGAGATGCAATCTACGCCAATGAATCAAAGATTAGTATCTAGTCTTTTAGATTTGATAATGAGACTAAAAGAACAAGTAAAATATAGTGTTGATACTGAAAGTACTTCCTCCACCGCCAAATCTAATAATGCTTTAGATAGTGCTAAATTGACATCTCAACAAGTGGTTACAATGATGGTGGATTCTGGAGCTGAATTGGCAAGGCTAGCTGCCTTCTTTTTCGTGGTGGTGGATAATACTGTAGTTAATCGCCATGAAGCATTCATTCTAACATCAAAACTTTTACCCTCGAATGAAAATAGAGGACTTAAAACTGTTGTAGAGTCATTCTTTAAAAATTTAACAATTAGTAACAAAGTCTCTACCTCGAATGAAGAAATGATGTCGGTGATGCCGTTCGAAGACGAACAACAACAACAACAATGCCCTCAACATGAACAACAACCGGATTTGAAAAGAGTGGTGGGAGAAGTATTTCTAGAAATGGGAAAATCAATAGTGAACTCATTCCCTTCCAATAAGAGTGTACAATTAACGGCTGACGCGTTCAAGCAAAACTACTCGCCTATGGGAAGACGCATAAATTTGGCGGCCAAGATAAAAACGGCTATATCTATCGGATCTAATATCTCGCCCAATATACTATTTTCTAACCTCCCAGAATCTGTAGGGAATAATACTGTAACTGGTCTAAGGCTAACCAACCTATTGAAAAACATATCCCAAAGTGCCCAAGCTAATAATATAATCAAAAATGCCAACACGCTCGTAAACAATACGATGGACCAACAAAACTCAGCAGCCATGTCCATACTACTCTTTCCTCCAACATCAAAAGAAACTTCTATCTTTCCCGGAAACGATCCTTCATCTATAAAATTACAGGATATGACTACAATGTCAAATCTGGCACGAGGATTTTATTCCATCGCAGAAGGATGTATCGGGGTCGTACGCTCGAGGGAATTTGATGAAGGAGGAGTTAAAGCGTACACTTTACTAGTGGACTCAAATACTATGGACATGGCAGTTAATTTTGCCGCTCAGTCTCTGGAAAAATCAATGTCTGAAGCCTTAACAAATAATGCGAATATGAACCCTTCTAATGTATTAGAAGGAGGATCTTTTGTAGACGGTGCTCTTTCTTACATGTTTGAAAAAAATGGCAGTGACTGTGAACCCACCCCTCTAGCAAAATATACAATGAAAGATGTATCAAATCGATACTTGAAAAAATTCAACAATGATAAAAATACACAAGATTTATATAAAAATAGAGCAGAAAGAGCACTCGTCGAACAGGTTACAAATAAGCCTACAAGTGTTGTGCATTCCCAGCTAGCAAACGCCATGGGGGTAGCTGTTATAGGCGCAGCATCAATCAAGCTCATGGAAGCAGAAGCAGCGGAATCTGAAATGAGAGCAGCAAATTATCAAGCAACATCAAAATCTACAAATGCTATTAATATAACAAATACAATTGGAATGATACGTAATACTACTCACCTGTGTACGACCATCGCCGTGAGTGCAGCCGCCGACATGTCAAAGCTCGCCAACAACCATTTTATGAGTGTATTAAACACTGCAAATAACAGTCATAGCAGCAGACGAGGAGACAGATCGTCCCTGATGTTGCAGCAACAACAACCAACACATTCAGCATTTCTGGAACAGACAAGAGGAAGAGGAGGAGGAGTATTAGGATCAGGAACTGAACAGACAAAGGATCATGTGGAACGTATGAAGAGAGATTGGATATTAAACATGATATCTCCAGAAGACAAAAATACTACTACTACTACACCCAGTAATGCCGGCCGGACATTAGGATATGGATCTAATATAACTGGCATAAACACGATAAAACAAGACGACAAGAGTATGATGGATAAACTTTCTGAGATGTCTAGCTTCAGAACTTAA

SEQ ID NO: 8 - protein, 1243 aa, Artificial Sequence
  Whispovirus wssv. >P5MICT165356 (VP136B)
MLGRIRSSASSTMSKSSSSTVKSASFFNSLMENAPSSKIELLEDGWTKKAAAADTDTPTAKPTGLSISLMDISGSMGSVKSAVADSCSGIMATLNVIAPGIQNAIVYYNDFDKHSIESGPVVRAPDCSEWEGGDFVKHMRKTEVCGGGGGGSEALHSSLMYVFNNMIPAFKKMHGITRDEKFPILIFVFTDEDVRIANSDTGKLCANSYDSETAPEEEFIMKTWGQKPLTILDMRKALVENDCWLRILNFSRCSGSNQSELCQEDVINFSGYDNNRWQLFESFDRRSCNVRKNIATFIMRQSISLFKNLNDQFSAFPILREINQEELNVFIESEGRSEPAGFEKYGDAQRESFKSRVLNMAPLDFGRVVQGGGRYNNHKRSVFLNCAYDSAFCCSKQTFNPQQQQQQQQSSSGGGGISKLAVVTQRAQSITGGGNAASTLALHMNACFQSLDDFGIDHTNLCDCKGCTKLMASVEATSDQGRKTKLSRKYARVHWAKMFAEKLFKMMIKEQSMMYACSAVPDEIGAIYAFVTGNNAGVCSRVSTILSDLGTECGNKAEYAFLKEGKHMKSASYDALQVINNTDLTPEQSSMFMWFYVPNDALEEAGKIFHQSFSFSNSYTGGGLLSLDEYKRFEFGQCFDFIKKLVSCLKITRNVEDVLLETSKTSNRYFAIPVFCGSDDQKEVLREELASDLFGGREDVAEMMFIDLETVIQKLGTLYDVRLSLPEGGYAAIKSVCAAASWAASCEVPSNTSNMILSIAKMAFTKYYQEQNSSSETDLDIILPSILEGTADGEIENNLSGVVFLRCLITWANKIGVDKNFTNKLEHFLALRILTKAGDSKIGEKYETFPVRRLDLSEKDLKYICKRCGVKSLKMEYDNDEKLCLRCKGNYRMGKPMVYHWDNKLTRDPRAKTASPTTLNLLNAKKIDDKVKEMASDIIGALNLPPTDKDNEIAVSAAAKAVGILYGKTCLLYKLLNEGNIDIPVAVCVECDCCKSKYMMSTLGPDKPQNRKCPWCRYANKLVAMGRGGKKLLMDLIECGAPSLAMVEEAIRTSGDVMYEELGEGEEFYIIDYFLKLKNTAIAEGNKLQQNNNKRPAPLQVTSPSSPPKKMRSDLPDSLLAAIGECAIETKEKTTVNLIGLGEVKVVENVGPNDLDGKDPFISLQEYCSWDKFNSLFVNPWLGYRLDEQWDDWNTFLIHVKKNDVWKFLCNKTSPFSVVVMNDGSGLLNVDNVNVLVRQKICV

SEQ ID NO: 9 - protein, 3720 aa, Artificial Sequence
  Whispovirus wssv. >P5MICG165356 (VP136B)
ATGTTGGGCCGTATCCGTTCAAGCGCTTCTTCCACCATGAGCAAGAGTTCTAGTTCTACTGTGAAATCTGCATCTTTTTTTAACTCTTTGATGGAAAATGCACCTTCCTCCAAGATTGAACTTTTAGAAGATGGATGGACTAAGAAAGCTGCTGCTGCTGATACAGATACTCCAACTGCAAAACCTACTGGTCTAAGTATCTCGTTGATGGATATTAGTGGTTCAATGGGAAGTGTGAAATCGGCTGTGGCTGATAGTTGTTCTGGCATCATGGCTACACTCAATGTGATTGCTCCAGGCATTCAAAATGCTATAGTTTACTACAATGATTTCGACAAACACTCCATTGAAAGTGGACCTGTTGTGCGTGCACCAGACTGTTCAGAGTGGGAAGGGGGAGATTTTGTGAAGCATATGCGCAAGACCGAAGTGTGCGGAGGCGGCGGCGGTGGCAGTGAAGCTCTTCATTCTTCCCTGATGTACGTGTTTAACAACATGATTCCTGCATTCAAGAAAATGCATGGCATTACCAGGGATGAAAAATTCCCCATCCTCATTTTTGTGTTCACCGATGAGGATGTGCGTATTGCCAATAGTGACACTGGAAAATTATGTGCCAACTCGTACGATTCGGAAACTGCACCAGAAGAAGAATTCATCATGAAGACTTGGGGACAAAAACCCTTGACTATTCTTGACATGAGGAAGGCGCTAGTGGAGAATGATTGTTGGCTACGCATCCTCAATTTCTCTAGATGTAGTGGCAGTAACCAGAGTGAATTGTGCCAAGAAGATGTGATCAATTTTTCTGGATACGACAACAACAGATGGCAACTTTTTGAATCCTTTGACAGAAGATCGTGCAATGTGCGCAAGAATATCGCAACCTTTATTATGAGGCAATCTATTTCCCTCTTCAAGAACCTGAATGATCAATTTAGTGCCTTCCCCATCTTGAGGGAAATCAACCAAGAAGAATTGAATGTTTTTATTGAAAGTGAAGGAAGATCAGAGCCTGCAGGATTTGAAAAGTATGGCGACGCTCAACGTGAATCTTTCAAGTCTAGGGTTTTAAATATGGCACCTTTAGATTTTGGAAGAGTTGTACAGGGAGGAGGAAGATATAACAACCACAAGCGTAGCGTGTTCTTGAATTGTGCATATGATAGTGCCTTTTGTTGCTCTAAGCAAACCTTTAATCCACAGCAGCAACAACAACAACAACAGTCTTCTAGCGGTGGTGGTGGTATCAGCAAACTGGCTGTAGTGACTCAAAGGGCCCAGTCAATTACAGGGGGAGGAAATGCCGCCTCTACTCTGGCACTGCACATGAACGCGTGTTTCCAGTCGTTGGACGATTTTGGAATTGACCATACAAACCTCTGTGATTGTAAGGGTTGTACAAAATTGATGGCAAGTGTTGAAGCTACATCTGATCAAGGAAGAAAAACCAAGTTGTCTCGCAAGTATGCTCGCGTACACTGGGCCAAGATGTTTGCTGAAAAACTCTTCAAAATGATGATCAAGGAACAATCAATGATGTACGCTTGCAGTGCTGTGCCTGATGAAATTGGGGCTATTTATGCCTTTGTTACAGGCAATAATGCAGGAGTGTGCTCGAGGGTCTCTACCATCCTTTCTGATCTGGGAACTGAATGCGGAAACAAGGCAGAATATGCCTTCCTAAAAGAAGGAAAGCACATGAAATCTGCTAGCTATGATGCACTCCAAGTGATTAACAATACAGATCTCACACCTGAACAATCCTCCATGTTTATGTGGTTCTATGTGCCCAATGATGCCTTGGAAGAAGCTGGCAAAATCTTCCACCAGTCATTTAGTTTCTCCAATTCATATACAGGAGGAGGATTATTATCACTGGACGAATACAAGAGGTTCGAGTTTGGACAGTGCTTTGATTTCATCAAGAAATTGGTATCATGTCTAAAGATTACTAGAAATGTTGAAGATGTGCTTTTGGAGACGTCAAAAACCTCCAACAGATATTTTGCCATCCCAGTCTTTTGTGGATCAGATGACCAGAAGGAAGTGCTTCGAGAAGAATTGGCCAGCGATCTATTTGGAGGACGAGAAGATGTGGCAGAAATGATGTTTATCGACTTGGAGACTGTGATTCAAAAATTGGGAACTTTGTATGATGTACGTCTGAGTCTGCCAGAAGGAGGTTATGCAGCAATCAAATCTGTGTGTGCAGCCGCCTCTTGGGCTGCCTCCTGTGAAGTACCCTCCAACACTTCAAACATGATCCTCTCTATTGCAAAAATGGCATTCACAAAGTATTACCAAGAGCAGAATAGCAGTTCCGAGACTGATTTGGATATTATTTTGCCCTCTATTCTTGAAGGAACTGCCGATGGAGAGATCGAGAATAATCTTTCCGGTGTAGTATTTTTGAGGTGCTTAATTACATGGGCCAATAAGATAGGAGTTGACAAGAACTTTACCAATAAACTAGAACACTTTTTGGCTCTGAGAATCTTGACAAAGGCTGGCGACTCAAAGATTGGGGAGAAATATGAGACGTTCCCTGTACGTCGACTTGACCTATCAGAGAAGGACTTGAAATATATATGCAAAAGATGTGGTGTAAAATCTCTAAAGATGGAATATGATAATGATGAAAAATTGTGCTTGAGATGCAAGGGAAACTACAGGATGGGCAAACCAATGGTCTATCACTGGGACAATAAATTGACCAGAGATCCTCGTGCCAAAACTGCATCACCCACAACCCTCAATCTTTTGAATGCCAAGAAAATTGATGACAAAGTAAAGGAGATGGCTAGTGATATCATTGGAGCTCTCAATCTTCCCCCAACAGATAAAGACAATGAAATTGCTGTTTCAGCTGCAGCGAAGGCTGTGGGGATTTTGTATGGGAAGACTTGTCTTCTCTACAAGCTATTGAATGAGGGCAATATTGATATTCCAGTTGCTGTATGTGTAGAATGTGATTGCTGCAAATCCAAGTACATGATGTCTACTCTTGGTCCGGACAAGCCGCAGAACAGAAAATGTCCCTGGTGCAGGTACGCCAACAAACTCGTCGCAATGGGGAGAGGAGGGAAGAAACTGCTGATGGATTTGATTGAATGTGGAGCACCTTCTTTGGCTATGGTGGAAGAAGCCATCAGGACATCTGGTGATGTGATGTATGAAGAACTGGGAGAGGGTGAAGAGTTTTACATTATCGACTATTTCTTGAAACTCAAGAACACTGCAATTGCCGAAGGAAATAAACTGCAACAAAATAATAATAAGAGACCAGCGCCTCTTCAGGTCACTTCTCCTTCTTCACCGCCAAAGAAAATGAGGAGTGATCTTCCCGATTCCTTGTTGGCTGCCATTGGCGAGTGTGCGATCGAGACAAAAGAAAAGACGACAGTCAATCTAATTGGACTCGGGGAAGTAAAGGTAGTGGAAAATGTTGGACCAAATGACCTGGACGGGAAAGACCCCTTCATTTCTCTCCAGGAATACTGTTCATGGGATAAATTTAATAGTCTATTTGTAAACCCATGGTTGGGGTACAGGCTCGATGAGCAATGGGATGATTGGAATACTTTCTTGATTCATGTAAAGAAGAATGATGTATGGAAGTTCTTGTGCAACAAAACTTCCCCATTTTCTGTTGTTGTAATGAATGATGGTAGTGGTCTGTTGAATGTTGATAATGTTAATGTACTTGTCCGTCAAAAA

SEQ ID NO: 10 - protein, 208 aa, Artificial Sequence
  Whispovirus wssv. >P5MICT164892
MHMWGVYAAILAGLTLILVVISIVVTNIELNKKLDKKDKDAYPVESEIINLTINGVARGNHFNFVNGTLQTRNYGKVYVAGQGTSDSELVKKKGDIILTSLLGDGDHTLNVNKAESKELELYARVYNNTKRDITVDSVSLSPGLNATGREFSANKFVLYFKPTVLKKNRINTLVFGATFDEDIDDTNRHYLLSMRFSPGNDLFKVGEK

SEQ ID NO: 11 - protein, 627 aa, Artificial Sequence
  Whispovirus wssv. >P5MICG164892 sequence_region_id=4491 start=1118 stop=492 length=627
ATGCACATGTGGGGGGTTTACGCCGCTATACTGGCGGGTTTGACATTGATACTCGTGGTTATATCTATAGTTGTAACCAACATAGAACTTAACAAGAAATTGGACAAGAAGGATAAAGACGCCTACCCTGTTGAATCTGAAATAATAAACTTGACCATTAACGGTGTTGCTAGAGGAAACCACTTTAACTTTGTAAACGGCACATTACAAACCAGGAACTATGGAAAGGTATATGTAGCTGGCCAAGGAACGTCCGATTCTGAACTGGTAAAAAAGAAAGGAGACATAATCCTCACATCTTTACTTGGAGACGGAGACCACACACTAAATGTAAACAAAGCCGAATCTAAAGAATTAGAATTGTATGCAAGAGTATACAATAATACAAAGAGGGATATAACAGTGGACTCTGTTTCACTGTCTCCAGGTCTAAATGCTACAGGAAGGGAATTTTCAGCTAACAAATTTGTATTATATTTCAAACCAACAGTTTTGAAGAAAAATAGGATCAACACACTTGTGTTTGGAGCAACGTTTGACGAAGACATCGATGATACAAATAGGCATTATCTGTTAAGTATGCGATTTTCTCCTGGCAATGATCTGTTTAAGGTTGGGGAAAAATAA

SEQ ID NO: 12 - protein, 972 aa, Artificial Sequence
  Whispovirus wssv. >P5MICT164925 (VP110)
MDERRRDPLLYPTNRSMRFTAQITLFVTVFVLGCIFALVCAAMAYNVAKPMSVNFQAIHELGMKSKLKAVQGANPEKTLEEYLEARGRHDGVEDASNYPPHPALLDMMNLTVKGNKWNVPSETKERNSRFESHDLAANRSSSLLVPEHHIDRLSEATIEKSNKYLDAVSGKKFRQRMVNLKDNIEKDDTELYDSLFGVHDIHHHSASGVSGDAPPPPPSTSEGHDEDVDILAYNTGGYCSNPVPLKEGQTCTSVCYTSRAVRVMTPFVAGGTFITHKSGEDPKPYCWSGNVPGDHIETSPTTGERVVKECSVHTSIVVLTDDGGWQCRPKYPTYFGGSGGTSMTACAFNPSTHKGPPPPSSSTPIYYDVLKKQQIRNHTEFRNSSYISKLRQSSSLAEFKIKCNDPEFLYKNPITCFCNNKKDVLNNDLLSQDVTKDMKFRGMYECMENPCVMMPNIDPSFVTFDVSTMKCVPGVNNPQDSNRHAIIGDDRTPLVGTVPAMGIFLADQSKRGDQIHQQRPKSSIDETTAKKIALAQAPIITPLNLDATNTSKNVLFVPIPSTVLPPLENIPHVIIRPSSLLHRSCLAPVLNKPSSGQHRPFCTAPFYIEPAANVLAGNIPQKPYEHSMLATECLRNSRMVSGSVHGGSELLFSTLLSQNKPSSYIRTPPGGTPAPEYNSTGDQRLEEIRDFFERNFNDERRLSQTEYVIKKHARGMRTSEIYLKSSSWDSLMKRKEFLRHIIKKSEDTFVLKEGLLMRSYGPYAATVLARDMFDLDYLKGKPASKTSSTLKVSNPLQYAFPTSYSVLPEEGATDDIFSVDHNRIFDSETIPSYFDCSNVTPGSEKLFGTSSSSSEYRVDIDDDAWGLQSFRLDHNPKSGPVVQSDPRLAFDASNISSTPEGATITPLSLFKKSLVEWGHKKADVQETSWFRDGVDTSEAYRRLLVETSMAVRNSWFSLAWENKNYYFAKNSS

SEQ ID NO: 13 - protein, 2919 aa, Artificial Sequence
  Whispovirus wssv. >P5MICG164925 (VP110)
ATGGATGAACGACGAAGAGATCCGTTACTTTACCCTACCAACCGAAGTATGCGCTTCACCGCGCAAATAACGTTATTCGTGACCGTGTTCGTGTTAGGCTGTATTTTTGCGCTAGTCTGCGCTGCAATGGCCTATAATGTAGCCAAACCAATGTCTGTTAATTTTCAAGCTATACACGAATTAGGGATGAAAAGTAAATTGAAAGCAGTTCAAGGAGCTAACCCTGAAAAGACACTAGAAGAATACCTAGAAGCCAGAGGTAGGCATGACGGGGTGGAAGATGCAAGCAATTACCCACCTCACCCCGCTCTCCTGGACATGATGAATTTGACTGTTAAAGGGAATAAATGGAACGTTCCGTCAGAAACGAAGGAAAGGAATTCTCGGTTCGAAAGTCATGATTTAGCTGCAAATAGATCCTCATCTCTTCTCGTGCCTGAACACCATATAGATAGATTGAGTGAGGCCACCATCGAAAAATCTAACAAATATCTAGATGCTGTATCGGGGAAAAAGTTTAGACAAAGGATGGTCAATTTGAAGGATAATATAGAAAAAGACGATACTGAATTGTACGATTCTTTATTTGGTGTACATGATATCCATCACCATAGTGCATCAGGCGTAAGTGGTGACGCTCCTCCTCCTCCTCCATCTACATCAGAAGGACATGATGAAGATGTGGATATTTTGGCCTACAATACTGGCGGGTACTGTTCCAACCCAGTTCCTTTGAAAGAGGGACAAACTTGCACATCTGTGTGTTATACCTCGAGAGCAGTTCGTGTGATGACACCATTTGTTGCTGGAGGAACATTTATCACACATAAATCTGGAGAAGATCCTAAACCTTATTGTTGGTCAGGAAACGTGCCCGGTGACCACATAGAAACATCCCCAACCACTGGAGAACGTGTAGTTAAAGAGTGTTCTGTGCACACATCTATAGTCGTTCTGACAGATGATGGGGGCTGGCAATGCAGACCTAAATACCCAACATATTTCGGAGGTTCGGGAGGAACATCGATGACTGCTTGCGCTTTCAATCCTTCAACCCACAAAGGACCACCACCTCCTTCATCTTCGACACCAATCTATTATGATGTATTAAAGAAACAACAAATACGGAATCATACAGAATTCCGCAACTCTTCTTACATCTCCAAATTGCGTCAATCTTCTTCCTTGGCGGAATTCAAAATTAAATGCAACGATCCTGAATTTTTATACAAAAACCCCATCACCTGTTTCTGTAATAATAAGAAGGATGTACTAAATAACGACCTTCTTTCTCAAGATGTAACAAAGGATATGAAATTCAGAGGTATGTATGAATGTATGGAAAACCCCTGTGTTATGATGCCCAACATAGACCCTTCGTTTGTTACGTTTGATGTGAGCACAATGAAGTGTGTACCGGGCGTTAATAATCCCCAAGACTCAAACAGGCATGCAATAATAGGCGATGACAGGACACCGTTAGTGGGGACTGTTCCTGCCATGGGAATTTTCTTGGCCGACCAATCTAAAAGAGGGGACCAGATTCACCAGCAAAGACCTAAATCAAGTATCGACGAAACTACTGCCAAGAAAATTGCACTGGCCCAAGCGCCCATCATCACGCCTTTAAACCTGGATGCAACAAATACTTCTAAGAATGTGCTCTTTGTACCAATACCTAGCACTGTTTTACCTCCTCTAGAAAATATTCCCCATGTAATCATCCGCCCGTCTTCATTGTTACATAGAAGTTGTTTAGCTCCCGTCCTGAACAAACCTTCCTCGGGGCAGCATAGGCCATTCTGTACTGCACCCTTTTACATTGAGCCAGCAGCTAATGTTTTGGCCGGAAACATACCTCAAAAACCCTATGAACATAGTATGTTGGCCACAGAATGTTTGCGAAATAGTCGCATGGTTTCGGGTAGTGTTCACGGCGGATCTGAACTTTTATTCTCTACACTTTTGAGTCAAAATAAACCCTCCTCTTATATCAGAACTCCCCCTGGAGGTACTCCAGCTCCAGAGTACAATTCTACAGGTGACCAAAGGCTGGAAGAAATAAGGGACTTTTTTGAACGTAATTTTAACGATGAGAGGAGATTGTCTCAGACAGAATACGTAATAAAGAAACACGCGAGAGGGATGAGGACAAGTGAAATATATCTCAAATCAAGTTCTTGGGATAGTTTAATGAAGAGGAAAGAATTTCTAAGACATATCATAAAAAAATCTGAGGATACTTTTGTATTGAAAGAGGGGTTATTAATGCGTTCATACGGACCTTATGCTGCTACTGTGCTAGCGCGAGATATGTTTGATTTAGATTACCTAAAAGGAAAACCTGCATCAAAAACTTCCAGTACATTGAAAGTGTCCAATCCTTTGCAGTACGCTTTCCCCACATCCTACTCTGTTCTTCCCGAAGAAGGAGCTACCGACGATATTTTTTCAGTAGACCACAATAGGATATTTGACAGCGAAACAATCCCCAGCTATTTTGATTGCTCCAATGTAACTCCCGGAAGTGAAAAATTGTTCGGAACATCATCTTCCTCATCCGAGTACAGAGTGGATATTGACGACGATGCGTGGGGTTTGCAATCGTTTCGTTTGGATCATAACCCCAAGAGTGGCCCGGTAGTACAGTCAGACCCTCGTCTAGCGTTTGATGCGTCAAACATTTCCTCAACCCCCGAAGGAGCTACAATAACACCCCTCTCTCTATTCAAGAAGTCACTCGTCGAGTGGGGGCATAAGAAGGCGGACGTGCAAGAAACTTCGTGGTTCAGGGACGGTGTGGATACTTCTGAGGCTTATAGACGATTACTTGTAGAGACTAGTATGGCTGTACGTAACTCCTGGTTCTCTTTAGCATGGGAAAATAAAAACTATTATTTTGCCAAAAATAGCAGCTAA

SEQ ID NO: 14 - protein, 800 aa, Artificial Sequence
  Whispovirus wssv. >P5MICT165333 (VP95)
MLSFNPEYASWFGKMITDPGVILPVSKDVVLFGSRGQSDVGIMTLDPHDLDIKITSKRIGVEERLAQYNTLPMDFTRAMEKELNNSRNMKESIFTGIFLDTGSAIFEDNMFNGGGSALRLIRSPALNSAVFSSKNYIIKQLPTITKSLRRSQARDKQVDKTREKIVVDSFSILSAIAAQVMHLTDGEMTYVPDGHCVNVVMSETNASSIYLIINDPTGSGWKIMPNNFNKTLEMRDGVIDRVETLVEFACKCVASSLIKRGMDLVDMQRTIRSMDFLPPASSTSNNTPRVAIMTSGSSTTTGIGSLSILAEDGSTHHQIKLSEYRTGLSITENNREVSFTVEPSIDGVQAEHPLSPSILQWLPPLVKRPEVVAAAAAAVVEEENGDNKPSDKDNEDKYSDTDFWSNVPVTPLITPKKWRACKINDRAMISSWKNNLVKLHKYDWTNKTTKVDYFDKMAAFVALMTFRKFQDILADNYVPPQTPSQGSEYAVTMSNVATLFTDVYGFESNGNKPLFALEQLENETGIESIYVLNIIGNSPDGNSVRVVRLEKEMSFLLKAKQYFTEMAIPPINEKCKWTDKAPSSVKEYKYFCDLTAPISKRPRKDNNDGGVEHSALTYTPRCIYHTERCLVHLYSEPEKITEHVSFNKDLNILEIGKNITNQYQTNYKSIFEIVDVPIIVASMSSTKTMTVNNYIISTPSATTKFVQDPPKTGKQLLAVEEVRNFKLKSVLVPPPYFRDNKRNTTLCSQITEQNCPSSSEGGRFSCPSESLILKYSNLSKKRALEEIAPETETSILSLAM

SEQ ID NO: 15 - protein, 2403 aa, Artificial Sequence
  Whispovirus wssv. >P5MICG165333 (VP95)
ATGCTCAGCTTCAACCCTGAGTATGCTAGCTGGTTTGGGAAAATGATCACCGACCCGGGGGTCATTTTACCCGTTTCCAAGGATGTTGTACTCTTTGGATCACGAGGACAATCAGATGTGGGAATAATGACACTGGACCCTCACGATTTGGATATAAAAATCACATCTAAACGCATAGGTGTGGAAGAAAGACTAGCTCAATACAATACTCTACCTATGGATTTTACACGGGCAATGGAAAAGGAACTAAATAATAGTAGAAATATGAAAGAGTCAATATTCACGGGAATATTTTTAGACACCGGTTCGGCAATCTTCGAAGACAACATGTTCAACGGAGGAGGTTCAGCTTTGCGCTTAATTAGATCCCCCGCTTTGAATTCTGCTGTATTTTCAAGCAAGAACTACATCATCAAACAATTGCCCACCATAACCAAATCTCTAAGGAGAAGTCAAGCTAGAGATAAGCAAGTGGATAAAACAAGAGAGAAGATAGTGGTGGATTCTTTCAGCATACTTAGTGCTATAGCTGCTCAAGTAATGCACCTCACAGACGGAGAGATGACGTACGTCCCCGATGGGCACTGCGTTAATGTTGTCATGTCAGAGACCAATGCTTCGTCCATCTACTTGATCATAAACGACCCCACTGGTTCGGGATGGAAAATTATGCCTAACAATTTCAATAAAACACTTGAAATGAGAGACGGTGTAATAGATAGAGTAGAAACATTAGTGGAGTTTGCGTGCAAGTGCGTCGCATCATCCTTGATTAAAAGGGGCATGGATTTAGTGGATATGCAAAGAACTATAAGGTCTATGGATTTCCTCCCTCCAGCTTCTTCTACTTCCAATAATACTCCTAGAGTAGCGATAATGACATCTGGAAGTAGTACTACTACGGGCATTGGATCCTTGTCCATTCTTGCAGAAGATGGATCAACACACCACCAAATCAAGCTATCGGAATATAGGACTGGATTATCCATTACTGAAAATAATAGAGAGGTGTCTTTTACGGTAGAACCTTCAATAGACGGCGTTCAAGCAGAGCATCCTCTATCCCCTTCTATTCTTCAGTGGTTACCTCCTCTAGTTAAAAGGCCAGAAGTGGTAGCAGCAGCAGCAGCAGCAGTAGTAGAAGAAGAAAACGGGGACAATAAACCTTCTGATAAAGATAACGAAGACAAGTACAGTGATACTGATTTTTGGTCTAATGTCCCCGTCACACCTCTAATTACACCCAAGAAATGGAGAGCGTGCAAAATAAACGATCGGGCAATGATTAGTAGTTGGAAAAATAATCTAGTGAAACTCCACAAATATGATTGGACAAATAAAACTACAAAGGTTGATTATTTTGATAAGATGGCTGCCTTTGTTGCCCTCATGACCTTTAGAAAATTCCAAGACATACTAGCGGATAACTATGTTCCTCCTCAAACCCCTTCTCAGGGAAGTGAATACGCAGTGACCATGTCTAACGTGGCTACACTCTTTACTGACGTGTACGGTTTTGAATCGAATGGAAATAAGCCATTGTTTGCCCTAGAACAGCTAGAAAATGAAACCGGGATTGAAAGCATATACGTCCTAAATATCATAGGAAATTCCCCTGATGGTAATTCTGTCAGGGTCGTCAGACTGGAAAAGGAAATGAGTTTCCTCTTGAAGGCGAAGCAGTACTTTACAGAAATGGCCATACCTCCTATTAATGAAAAATGCAAATGGACAGATAAGGCCCCGTCATCTGTAAAGGAGTACAAGTATTTTTGTGATCTAACAGCACCCATTTCAAAGAGACCTAGAAAAGATAACAACGACGGCGGTGTGGAGCATTCTGCGTTGACTTATACACCTAGGTGCATATACCACACTGAACGTTGTTTAGTCCATCTTTACTCTGAGCCAGAAAAAATAACAGAACACGTATCTTTCAACAAGGATTTGAACATATTAGAAATTGGAAAAAATATTACCAACCAATACCAAACAAACTACAAAAGCATATTCGAAATTGTGGACGTTCCCATAATTGTCGCCTCTATGTCATCAACAAAAACAATGACTGTAAACAACTACATAATTTCAACACCTTCTGCCACGACCAAGTTTGTTCAGGATCCGCCAAAAACAGGGAAACAACTTCTGGCAGTTGAAGAGGTCAGAAACTTTAAACTCAAATCTGTTCTTGTTCCTCCTCCTTATTTTAGGGACAATAAGCGCAACACAACTCTTTGTTCACAAATAACTGAACAAAATTGCCCGTCATCTTCTGAAGGTGGGCGTTTTTCATGTCCATCAGAGTCACTTATTCTCAAGTACTCTAATCTCTCTAAAAAGCGCGCACTGGAAGAAATTGCCCCAGAGACTGAGACTAGCATTTTGTCACTAGCCATGTAA

SEQ ID NO: 16 - protein, 786 aa, Artificial Sequence
  Whispovirus wssv. >P5MICT165223 (VP75)
MEYMEEGDIAERRSEGVDYILDENSACVVNVKSIRNRLGAMDAEEAQYAQDISAQLVTHIIRLAHCSESNKIKDTIASIAGLFINNIFDNNSTKNKLKTYNQFKAESQNKSSVLNIFGSLDPLSMLSSFMGSDPAKSGGENLDKSLGVLFEVLQNYNPCKIDDIVLLEMCPSKCAACTGLKEAIRQEQPMEAMLLFFKCINHNRFNFGSDIKSAYASETCMRYSQDERAVVVPLRSILLGCLDRDDPAHTLSSFGDTIEYADSDNAWVSSLFAAVSRMPMVDRAVIAHFYVYTMLSRHRRVSGDSFKQFVYTVFVRMIYSAIEILFCDTENSSVECDGKHFLSYVNAMVNVSVLGSTFNVLKAYRSWVVDQASVAPVLDIISGGWKKNYPSPDHIKRVAYDISQVINHLASPSRMVKGNNKASNVTSGLDSIRSVRQAEKYIPFGILENKAGYGVINIAKHNISRPAREQSNGRNFNCNALHILPSIKGCEALGAQKGSADQTVNVFDNFVASHMDIAMKKQGSGKILGLLTSMIDRQGLTTSFPSSEAEYKKRIHDFTRYVIFSSTPINDELVNSRCILPHSNVLNSPISLRNIDPESVPDTRFHFLLMMWQRPNIDEPNLSALTTSQLELLLSKNQKWDKLTTRAFFNIDRINFQMADAIIKNVSGSGFLDGSKTASSSSSAPNFFQIFSGAECTAKQLQSIRKFIGESMQHVQKEWSSAVNNGNRGVENYDGLNAQFSEELFELLYKLIIEEDMRPSSLIASSEFLSNYVNAMDELLIRANAS

SEQ ID NO: 17 - protein, 2361 aa, Artificial Sequence
  Whispovirus wssv. >P5MICG165223 (VP75)
ATGGAGTACATGGAAGAAGGAGACATCGCTGAAAGGCGCTCAGAAGGTGTCGACTATATTCTGGACGAAAACTCTGCTTGTGTAGTTAATGTGAAGAGTATCCGTAACAGGCTCGGTGCCATGGACGCCGAGGAGGCACAGTACGCACAGGACATTTCCGCCCAACTTGTCACCCATATTATCCGTCTGGCCCACTGCTCCGAATCCAACAAGATTAAGGATACCATTGCCAGTATTGCGGGTCTTTTCATCAACAACATCTTTGACAACAATTCAACAAAGAACAAACTTAAAACGTATAATCAATTCAAGGCAGAGTCACAAAACAAGTCTAGCGTTCTCAATATCTTTGGCTCTCTAGATCCTCTGAGTATGCTTTCTAGCTTCATGGGTTCTGATCCAGCAAAGAGTGGAGGGGAAAATTTGGACAAATCTTTGGGTGTGCTCTTTGAGGTGCTTCAAAATTACAACCCTTGCAAGATTGACGATATTGTCCTTCTGGAAATGTGCCCATCCAAGTGCGCCGCCTGCACCGGTCTCAAGGAAGCCATCCGCCAGGAACAACCCATGGAAGCAATGTTGTTGTTTTTCAAATGTATCAACCATAATAGGTTCAATTTTGGAAGCGACATAAAGTCAGCATACGCCTCTGAAACATGCATGAGATACTCTCAGGACGAACGCGCAGTCGTTGTGCCTCTGAGGAGTATCCTCCTCGGCTGCCTCGACAGGGATGATCCAGCTCATACTCTTTCCTCTTTCGGGGATACTATCGAGTATGCTGATTCAGATAACGCTTGGGTTTCTTCCCTGTTTGCAGCCGTCTCTAGAATGCCTATGGTAGACAGAGCCGTTATTGCTCACTTTTACGTGTACACAATGCTCAGCCGACATAGGCGAGTATCTGGAGACAGCTTCAAGCAGTTTGTCTATACCGTATTTGTTCGTATGATTTACTCTGCGATTGAAATTTTGTTCTGTGATACTGAAAATTCGTCTGTAGAATGTGATGGAAAGCACTTTTTGAGCTATGTTAATGCCATGGTTAACGTATCCGTGCTGGGTTCTACGTTTAACGTACTAAAAGCCTACCGTTCATGGGTGGTGGATCAAGCATCCGTCGCACCGGTTCTAGACATTATTTCCGGAGGATGGAAGAAGAACTACCCCTCACCTGACCACATCAAGAGGGTGGCGTACGACATCTCTCAAGTCATCAATCATCTTGCATCACCTTCTAGAATGGTTAAAGGTAACAACAAGGCTAGCAACGTTACATCTGGCCTGGATAGTATCAGGTCTGTTCGTCAAGCAGAAAAATATATCCCGTTTGGAATACTTGAAAATAAAGCAGGGTATGGTGTAATAAACATTGCCAAGCACAACATCAGCCGTCCAGCAAGAGAACAATCCAACGGAAGGAACTTTAATTGCAACGCTTTACACATTCTACCTTCAATTAAGGGCTGTGAGGCACTTGGGGCACAAAAGGGGAGCGCAGATCAAACTGTCAATGTTTTTGATAATTTTGTCGCATCTCATATGGATATTGCCATGAAAAAGCAGGGGTCGGGGAAGATTCTTGGACTGCTCACTAGCATGATTGACAGGCAAGGTCTGACTACTTCATTCCCTAGTAGTGAAGCGGAATACAAGAAGAGAATCCATGATTTCACAAGATACGTCATCTTCTCTTCAACACCCATCAACGACGAACTAGTCAATTCTCGCTGTATTCTTCCCCATTCTAATGTTCTGAACTCCCCTATCAGCTTGAGAAATATTGACCCAGAATCAGTCCCCGACACTCGATTCCACTTTCTGCTCATGATGTGGCAGCGGCCAAATATCGATGAACCTAATCTTTCTGCTCTAACTACAAGTCAGCTAGAATTGTTGCTTAGCAAGAACCAAAAATGGGACAAACTCACCACCAGAGCGTTCTTCAATATCGACAGGATCAATTTCCAGATGGCAGACGCTATCATTAAGAACGTTTCTGGAAGCGGCTTCCTAGATGGGAGTAAAACTGCCTCTTCTTCTTCCTCAGCGCCTAACTTTTTCCAAATCTTCAGTGGTGCTGAATGCACTGCAAAGCAGCTCCAAAGTATTCGCAAATTCATTGGAGAATCTATGCAGCATGTACAAAAGGAATGGAGTAGTGCAGTAAACAATGGGAACAGAGGAGTAGAAAATTATGACGGACTCAATGCTCAGTTCTCTGAAGAACTGTTCGAGCTGCTCTACAAATTGATCATCGAGGAGGATATGCGGCCATCCAGCCTGATCGCCTCATCTGAATTCTTGAGCAACTACGTCAACGCCATGGATGAACTTCTTATCAGAGCTAATGCTTCTTAG

SEQ ID NO: 18 - protein, 674 aa, Artificial Sequence
  Whispovirus wssv. >P5MICT165110 (VP73)
MAGNRTQFVSSLIAKCISDVEQGMECCGRQAQDALMTRLANLKLGDSLKETDVNLEYLRYASTPLLGELNYDKQQYAATVDINLMAHFSYAALGIESILNSIRRVVVANHQRRNNGKKPSEPISRPHPLGGVEPPLSSELANAIRDKFISMGALDRLNSAIVTAALGAIASERELFLRENAVNYMYDVEFAERDAATTDTGNVVYLSTKMDEDEDDIIKRSEILDKVSKRPAKEGIDWRPTPDNSFPYQLIWGDDSVDDTVLIDLITNAIVPNIFMAKFILFICNHLRAVIRSMREILYGNISSSSDNYFEDGRKWCFWLNLYNRLEWFMLVVRFVIFLHSKKESFSGADNVNVKRLLVVVVESFPPVLLDTEWVKTNITSWPVINNSNNNSTLPVTEDTLMRLAIRTSSGARHPIFDEINSLTTAVTNRITFQSAEFCTKILLGRALDEEEAGTKMLVKSVKETGEEKDKNNTFSSFGLLLKNTKNEELEINIGDNDDETTDVACWARTSSTSFIRNRTYAFKKIWGLEDASDVVELKRESDAITSFVTDKSSPLLFPYVSDWSCLLLHPCCKAPAIIKSVWLQILKDFSQENIKTINEKVQSLSSEICQKSNDRFKNKKIAAEHVRSVKKLLNTISNREQEAALSTEHCIWLTILWKQVVQNTLNLLENFPV

SEQ ID NO: 19 - protein, 2025 aa, Artificial Sequence
  Whispovirus wssv. >P5MICG165110 (VP73)
ATGGCAGGGAATAGAACCCAGTTCGTATCGTCCCTGATTGCTAAATGTATATCAGACGTGGAACAAGGCATGGAGTGTTGTGGCAGACAAGCACAGGATGCATTAATGACTCGCCTAGCCAACTTAAAATTGGGCGATTCTCTTAAAGAAACTGATGTTAATTTGGAATACTTGAGATACGCGTCTACGCCCCTCCTTGGGGAATTAAACTACGACAAACAACAATATGCGGCAACAGTTGACATCAACCTAATGGCTCATTTCTCCTACGCTGCTTTGGGTATAGAAAGTATACTGAATTCTATACGGAGAGTTGTAGTGGCTAATCATCAACGTAGAAATAATGGAAAAAAACCTTCTGAACCAATCTCACGCCCTCACCCGCTGGGAGGGGTAGAACCTCCTCTATCGTCAGAGTTGGCAAATGCAATAAGGGACAAGTTCATCAGCATGGGGGCGTTGGACAGATTGAATTCAGCAATAGTGACAGCGGCCTTGGGGGCTATTGCCAGTGAACGTGAACTATTCTTACGTGAAAATGCTGTAAACTACATGTACGATGTAGAATTTGCAGAAAGAGATGCTGCTACTACAGATACAGGGAATGTAGTCTATCTTTCCACCAAAATGGACGAAGATGAAGATGACATAATAAAGCGTTCAGAAATATTAGATAAGGTATCAAAACGACCCGCAAAGGAAGGTATAGACTGGCGCCCCACCCCTGACAATTCGTTCCCTTACCAATTGATTTGGGGCGATGATTCTGTAGATGATACTGTTCTTATAGATCTCATCACCAATGCGATCGTGCCTAATATTTTTATGGCAAAATTTATCCTGTTCATATGTAACCATTTAAGGGCAGTTATTAGGAGTATGAGGGAAATTTTATACGGTAACATTTCTTCTTCATCCGATAATTATTTTGAGGATGGACGTAAATGGTGCTTCTGGTTGAACCTGTACAATAGACTGGAATGGTTCATGTTAGTAGTTAGATTTGTAATTTTCCTCCACTCAAAAAAGGAGTCCTTTTCAGGAGCTGACAATGTTAACGTGAAAAGACTTCTGGTGGTAGTTGTGGAGAGTTTTCCTCCCGTTCTCTTGGACACTGAATGGGTCAAGACTAATATAACGTCATGGCCTGTTATTAATAACAGCAATAATAATAGTACACTCCCTGTGACAGAAGACACCTTAATGAGACTAGCGATAAGGACGAGTAGCGGTGCCCGACATCCTATTTTCGACGAAATTAACTCCTTGACAACAGCAGTGACCAACCGTATTACCTTCCAGTCTGCAGAATTCTGCACAAAGATTTTGCTCGGGCGAGCTCTGGACGAAGAAGAAGCTGGAACAAAAATGCTAGTAAAATCAGTCAAAGAGACGGGAGAAGAAAAGGATAAGAACAATACGTTCTCTTCATTTGGTTTATTACTGAAGAACACAAAAAATGAAGAATTGGAAATAAACATAGGCGATAACGATGATGAGACTACAGATGTGGCTTGTTGGGCACGTACTTCCTCGACATCCTTTATCCGTAATAGGACATATGCGTTTAAAAAAATATGGGGCCTTGAGGATGCAAGTGATGTAGTCGAGCTGAAGCGAGAGAGTGACGCCATTACATCCTTTGTCACCGATAAGAGCAGTCCTCTCCTATTTCCGTATGTGTCCGACTGGAGTTGCTTACTATTACATCCCTGTTGTAAAGCACCGGCCATAATTAAAAGTGTGTGGTTACAAATCCTGAAAGATTTTTCCCAGGAAAATATAAAAACTATAAATGAAAAGGTACAATCTCTTTCATCTGAGATTTGTCAGAAATCAAACGACCGTTTTAAAAATAAAAAAATTGCTGCCGAACACGTTCGCAGTGTAAAAAAGTTATTAAATACGATAAGCAACAGGGAGCAAGAAGCAGCACTATCTACAGAACACTGTATTTGGTTAACGATTTTGTGGAAACAAGTCGTTCAGAACACTCTCAACCTTCTGGAGAATTTTCCCGTATAA

SEQ ID NO: 20 - protein, 465 aa, Artificial Sequence
  Whispovirus wssv. >P5MICT165216 (VP60A)
MAVGDYLSMSSVGEATLVGFMILNFINFVTILSLIIYAVTDVYRRCKRPSTNGYSGCTTNVVSSTLQEANLVTTEKDKPVQFVRGLVPRKMMEKYRSDLSPKNVGEYILPSEKETDKLKSDYKKGKKVGLLTALSNGHDSNKRIIGPRDLISRDDVKDKSYVFKRLSKDPLVYYSSATSKYVRKFSPFRAKKFMTSTQLGSKLVYPHPIRYGTAFVLPTGYVINKAYGMDNEDLHTWNPPSSSVLVPDSNNDRLTVECAKTDPTHRIGIYGFGGSDDNRRAKEEGYVEMLLCNCDNHKDLLKAPLITEYSTNPTEIQVDVAAKRVLFPAPGSEPVKSSQVTSAAHQLDGATGEHDISHEPVKLSDTGDYAVGSPIVFKPVYGTSLVNLPETGSPLALNCPCTDKADGIYQVNQKGGILYRDMVGYLNANPVEAASLSSSDSSSWLTTGNKISSVTCEGEKIKKIV

SEQ ID NO: 21 - protein, 1398 aa, Artificial Sequence
  Whispovirus wssv. >P5MICG165216 (VP60A)
ATGGCTGTAGGGGATTATCTTTCTATGTCCTCTGTAGGGGAAGCAACGCTCGTGGGTTTTATGATTTTAAATTTTATAAACTTTGTCACAATATTATCTTTAATAATATATGCCGTGACAGACGTTTATAGAAGATGCAAGCGGCCGTCTACCAATGGATATTCTGGTTGTACAACCAATGTGGTTTCTTCGACTTTACAAGAAGCTAATCTCGTTACCACTGAAAAAGATAAACCTGTTCAATTTGTTAGAGGTTTAGTCCCCAGAAAAATGATGGAAAAATATAGATCGGACTTGTCTCCTAAGAACGTGGGGGAATATATTTTACCTTCAGAAAAAGAAACAGACAAATTGAAAAGTGATTATAAAAAGGGTAAGAAGGTTGGTCTTTTAACTGCCCTGAGTAATGGTCATGACAGTAACAAGAGGATTATAGGGCCAAGGGATCTGATTAGTAGAGATGATGTGAAGGACAAAAGTTATGTCTTTAAGAGATTGAGCAAAGATCCGCTCGTCTACTACTCTTCTGCAACCTCTAAATACGTTAGAAAATTTTCCCCTTTCAGAGCAAAAAAATTCATGACATCAACACAGTTGGGGAGTAAGCTCGTGTATCCTCACCCTATACGGTATGGTACTGCTTTTGTACTACCCACGGGATACGTGATCAACAAAGCATACGGAATGGATAATGAGGATCTACACACTTGGAACCCACCCTCTTCTTCTGTGCTCGTCCCAGACTCTAATAATGATAGATTAACAGTAGAATGTGCTAAAACGGACCCAACACATAGAATCGGCATCTACGGCTTTGGAGGGTCTGATGATAATAGACGTGCAAAAGAAGAAGGTTATGTAGAAATGTTGTTATGTAATTGTGACAACCACAAGGACTTGCTTAAGGCTCCTCTAATTACAGAGTATTCTACAAATCCAACTGAAATTCAAGTAGATGTTGCTGCAAAACGTGTTTTATTCCCTGCCCCTGGTTCCGAGCCTGTAAAATCTTCCCAAGTGACATCTGCTGCTCATCAACTAGACGGAGCTACTGGCGAGCACGATATTTCCCATGAGCCCGTGAAGCTATCAGATACGGGTGACTATGCAGTTGGATCACCCATTGTATTCAAGCCAGTTTATGGTACATCTTTAGTAAATCTTCCAGAAACAGGATCTCCTCTGGCATTGAACTGCCCCTGCACCGACAAGGCTGATGGAATATATCAAGTCAATCAAAAGGGAGGGATATTATATAGAGATATGGTGGGGTATCTTAACGCCAACCCTGTGGAAGCTGCATCACTTTCTTCCTCGGACTCTTCTTCGTGGTTGACAACTGGTAACAAAATATCTTCTGTTACATGTGAAGGAGAAAAAATAAAGAAAATTGTGTAA

SEQ ID NO: 22 - protein, 544 aa, Artificial Sequence
  Whispovirus wssv. >P5MICT165306 (VP60B)
MFRQFCSLYLLQRRVNDNLRSTASASAAASLKGDGTEFITGEPPSHKMRGPSYSVLGPDPCEDPERVYVDIVVSILQTNNIQVTKEWELFSDKLRKLGPWIDRSGIENNGEGEEDGDENEDGGGNGGRIEDREAHRRKMMKKLSFVGREDPVAVDLPTWRENSTEFARRLTLKELCDLIVECGCIKSKEELFDFIFEEPWEIKEAADVRGMANRSKFTKESLIDWFFEFDTYSKCVVFFEAVNWYLKSQASPISLVLDDIYCCVFSYIRRQTFLTRAKNPSLTVASSFSPTPDTKLLAIDECVQHFLKSDINISQMALTERDCFFPLLTEMPRQQKKVNTFLDTMKRPTLSLLPSTSSSSSSNNKRKRNTAAANILLPVYRSNFSTASNNKRLKTDDGENASACILIEGYANGKISPIRIMVRKSTIIPEVFNHLLFPVFASKDTGANILFFIKMKSFASASLLLPGLFRHPKQFLNGPCKWMTLAENNINDNNINSSTMWSYTLADYCPLGYYTQESPQPYQTCGNFTSTTNKRLQNVQPLYF

SEQ ID NO: 23 - protein, 1635 aa, Artificial Sequence
  Whispovirus wssv. >P5MICG165306 (VP60B)
ATGTTCCGTCAATTCTGTTCACTATATCTTCTTCAACGCCGGGTTAACGACAATCTTAGATCCACGGCGTCCGCTTCGGCAGCGGCCTCATTAAAAGGAGATGGAACTGAATTTATAACCGGAGAACCACCTTCTCATAAAATGAGGGGACCTTCTTATAGCGTTTTAGGACCTGATCCGTGCGAGGACCCAGAAAGGGTATATGTTGATATTGTAGTGTCTATTTTGCAGACAAATAATATACAGGTAACAAAAGAATGGGAATTGTTTTCCGATAAGTTGAGAAAATTGGGTCCATGGATTGATAGGAGCGGAATTGAGAATAATGGCGAAGGAGAAGAAGATGGAGATGAAAATGAAGACGGGGGTGGAAATGGGGGAAGAATTGAAGACAGAGAAGCACATCGACGAAAAATGATGAAGAAATTGTCCTTTGTTGGAAGAGAAGATCCAGTCGCTGTAGATTTACCCACGTGGCGAGAAAACAGTACAGAATTTGCACGTCGTTTAACACTCAAGGAATTGTGCGATTTAATAGTTGAATGTGGATGCATCAAATCAAAAGAGGAACTCTTTGACTTCATTTTTGAAGAACCGTGGGAGATTAAAGAGGCTGCTGACGTTAGGGGTATGGCAAACAGGAGTAAATTCACCAAGGAATCATTAATTGACTGGTTTTTTGAGTTCGACACATATAGTAAATGTGTAGTATTTTTTGAAGCAGTCAACTGGTACTTGAAATCTCAAGCGTCTCCAATTTCATTGGTACTAGATGATATATATTGTTGTGTCTTTTCCTACATAAGACGCCAAACCTTTTTAACTAGGGCAAAAAACCCATCTTTAACAGTGGCTTCATCCTTTTCTCCCACGCCCGACACAAAGCTTTTGGCTATCGACGAGTGCGTGCAACACTTTTTAAAATCAGACATTAATATTAGCCAGATGGCATTAACTGAAAGGGACTGCTTCTTCCCTCTTTTAACTGAAATGCCCCGCCAACAAAAAAAAGTAAACACCTTCCTGGACACAATGAAGAGACCTACCTTATCTCTTCTACCTTCCACCTCCTCCTCCTCTTCTTCCAACAACAAGAGAAAGAGAAATACTGCCGCTGCCAATATTCTTCTTCCAGTGTACAGGAGTAACTTTTCTACAGCATCCAATAACAAGAGACTGAAAACTGATGATGGGGAAAATGCATCAGCCTGTATTCTTATCGAAGGGTATGCGAATGGAAAAATAAGCCCTATAAGGATTATGGTAAGAAAATCAACTATTATTCCAGAAGTGTTTAACCATCTTTTGTTCCCTGTCTTTGCCTCTAAAGACACTGGTGCGAATATCTTATTTTTTATCAAAATGAAATCCTTTGCAAGTGCATCTTTACTCCTCCCTGGACTTTTTAGACACCCCAAACAATTTCTCAACGGGCCGTGCAAATGGATGACTCTAGCAGAAAACAACATCAACGACAACAACATAAACTCTTCCACGATGTGGAGTTACACGCTAGCAGATTATTGTCCTCTGGGCTATTACACCCAAGAGAGCCCTCAACCCTATCAGACATGCGGCAATTTTACTTCGACTACAAACAAGAGACTACAAAACGTGCAGCCATTATACTTTTAA

SEQ ID NO: 24 - protein, 388 aa, Artificial Sequence
  Whispovirus wssv. >P5MICT165417 (VP55)
PVYRVPLFSLKDGSDPHERDFSFNVDPRRFGKVPVKVRRVDVRNPSRTAAIFVPTGPGLHVSSYTGDGMLVCPNHNFIGDLCSEIASDITIYNTSSSGRLSYATNFNSVEDNSPVGILFETLPDDKMFQQVSIFSATEPASNISIGPMSHVKIKLGYYDEENATAVGVIRYGGLFYTSVGACIIPEGVFFDDVVGNHSSMNIYNMTNQPKEIVLKEPRGEDAMEEDDGEEADYNFLGYVVRFEHDLKMQAMSSAYSSVSIDINSSSFHKCFLIKPKYNSILQPLVSSEVVLNDLSLNTRGREVEFHDRLPSGAQDNSYSIVKYMKIVSLKEGLKVVNPIINTELYKKKQALKVHVLNMTRDVVGLDTSEHSFGVIVCHAAKLPEVIGQ

SEQ ID NO: 25 - protein, 1347 aa, Artificial Sequence
  Whispovirus wssv. >P5MICG165417 (VP55)
ATGGGAGGTGAAGATTCGTTCGACGACAGGTACGATTCTGATGCGCTCTGGGAAAATGAAGGAGCAAAATCGATTCAAGTAAAGGAAACGGATTTGGAGGTGTACCGAATGCACCGCAGAGCGGTACCCACTCTAGAAGAAAAAAATAGAACAGCTTTAAGGTACTATTCAGATTGGTCTCCTGTTTACAGAGTGCCTCTCTTCTCTTTAAAGGATGGAAGTGATCCCCACGAAAGAGATTTTAGTTTCAATGTAGATCCACGACGATTTGGAAAAGTACCAGTGAAGGTGAGACGAGTTGACGTGAGAAATCCTTCACGAACGGCTGCCATTTTCGTGCCAACTGGACCAGGACTTCATGTATCGTCTTACACTGGAGACGGGATGTTGGTCTGCCCTAATCACAATTTTATAGGAGATCTTTGTTCTGAAATAGCATCCGATATAACAATTTATAATACAAGTAGTTCAGGGCGGCTATCTTATGCAACAAACTTTAATAGTGTTGAAGATAATTCCCCTGTCGGTATTTTATTCGAGACTCTTCCTGACGACAAAATGTTCCAACAAGTGTCTATTTTTTCCGCTACTGAACCGGCTTCCAATATCTCTATCGGACCCATGAGTCATGTGAAAATCAAGCTCGGTTACTATGATGAAGAGAACGCTACCGCAGTCGGTGTCATTAGATATGGAGGATTATTCTACACCTCTGTCGGTGCATGCATTATCCCAGAAGGGGTTTTCTTTGATGATGTTGTGGGAAATCATAGCTCAATGAACATATACAACATGACTAACCAACCAAAAGAAATTGTACTAAAAGAGCCAAGAGGAGAGGATGCCATGGAAGAAGATGATGGTGAAGAAGCAGATTATAATTTCTTGGGTTATGTAGTAAGATTTGAACATGATTTGAAAATGCAAGCCATGTCGTCAGCATATAGCTCAGTTTCTATTGATATTAACAGTTCAAGTTTCCACAAATGTTTCCTAATTAAACCTAAATATAACTCTATTTTACAACCTCTCGTTTCTTCAGAAGTTGTGCTTAATGATCTCTCGCTCAATACACGTGGGAGAGAAGTAGAGTTTCATGACAGGCTCCCGTCTGGTGCACAAGACAACTCATATTCGATTGTAAAATACATGAAAATAGTATCTCTAAAGGAAGGCCTAAAGGTTGTAAACCCTATAATCAATACAGAATTGTATAAGAAAAAACAGGCTTTAAAGGTGCATGTTTTAAATATGACGCGTGATGTTGTGGGACTAGATACGAGTGAGCATAGTTTTGGAGTAATAGTGTGTCATGCTGCAAAACTTCCCGAAGTGATTGGTCAATAA

SEQ ID NO: 26 - protein, 1301 aa, Artificial Sequence
  Whispovirus wssv. >P5MICT164901 (VP53A)
MWLMTSCPIYVLVGCNTSLYKAIEGVKTKHTMVLTLSCTTRRVASSKGNFSKEDAVLGNQFPILKKSNNLSIARPPSIESFSASVEKIFREWNESGGEKIFDISQNEEEWMDIISLVESVYEPVFSKSLKPDKLADKTCLTAAAFAALASAVDEKLTILSGSDGSVLQRTTKVMKKDPKKIAESLLNNEKWTSILLDRLKTAKKLLSRRGALKSAERVEVLHRLNKLKEAPLPHHPSLFDNFSGGKTSAVSAGTVIASDMHFKLVEHIFKVSFRKWGPCGDKTESGEEEDEEEEEEEKKHSISRFVLQFMNGHNGQHYHRPESASVYFCDYYDYLAYRNLPNEYKLSSMHPGTFNMEDLPFRPFAVPSTYKTELEYKRFVQSTNLPQLSFDYGEFLCYCIFGADWYKHLGDVVDSLENSSMISFDSQTLSGVYKNTANYKRLGKKRNGIADLAVRSMAEFIRTEAHKALTAEEMEEEEEEEEAEEEAMDQEPAEVDFLSVPHLRRKIRQAVSVLNNFVENDLSILVSNFKNVLTDDTVSGTDTDNFGSSGEFEALSSHLFLSRILDEVHILRNTDIQRTLFSTHVSLSDKSPPSRVRGSNVNFNNNAGNISSLQTYGGIEELPENVLVGLSGGFEDTDMYSGEDVVVVWDGCDGGKVLSVTFNCGDNFIQLHEKTAETFKDDTDLVERIRDVLQTASKTGNLNKKAYSRKNIYAVLRENGIERPGDDFTEKGIALKDKTNQPPPPARSAKITVEGVKGFFSGFRDILETRALTTYSAETFRDLGQGIVKETEGLTAATVAETSFSEGLAESLRSDANLGLEFSEDAKTVVFKNDTSRSLLEETRALRANNTSFSSFARDMGVQVSADLDAEFAAEMRETYPDAALEQNLKDLDKFEETIPESQVKKLKKIDSYLTENPERAGKEINDTELSKATDSVLGKKLGNAVTVLMNNFGKVTIVVGASVVAGFLGPAAVALVHASRGAHLNVVDHTSPKGVISYKIVDFSCADRNTGWAKPTKHPFREEIDHVIALDASFLTENGAYVFPEDGGPKSKYKAYAPICGTKDAAQGECGSWATFDDPHSVLPWVASMKDLPKGQSLSCDKGMSTLKAVSSVLLSIGKDVAEAIFEVAEDAVVGLASKAISAVINNPLFIFGVPLGFGIAATRLNPSNWKTGLIVFSILLVVILIVRFFAGSGPLTLNWFGAKNSAKRKQTEQFEDGGGNRSKIVLAEKDNANSKLQSRRNETGPMRLEELPGHEDLRPVFFPATTNYSKSAKILGYKSKPFNDFYTKIINTDIIKMDR

SEQ ID NO: 27 - protein, 3906 aa, Artificial Sequence
  Whispovirus wssv. >P5MICG164901 (VP53A)
ATGTGGCTCATGACCTCATGTCCGATATATGTATTGGTTGGGTGTAATACAAGTCTCTACAAAGCAATAGAAGGGGTAAAAACAAAACACACCATGGTGCTAACTCTTTCCTGTACGACTAGGCGCGTAGCGTCTAGCAAGGGGAATTTCTCTAAGGAAGATGCGGTGTTGGGGAACCAGTTCCCCATTTTAAAGAAATCAAACAACTTGTCAATTGCAAGACCTCCCTCAATAGAATCTTTTTCTGCATCAGTGGAAAAAATATTCAGGGAATGGAACGAAAGTGGGGGAGAAAAAATTTTCGACATATCTCAGAATGAAGAAGAATGGATGGATATCATATCCTTAGTGGAAAGTGTATATGAACCTGTATTTTCTAAATCACTTAAACCTGATAAATTGGCAGATAAAACATGTCTAACCGCGGCTGCCTTTGCAGCACTAGCTTCTGCCGTGGATGAAAAATTGACAATCTTATCAGGTAGTGATGGGAGTGTGCTTCAACGTACAACAAAGGTTATGAAAAAGGACCCCAAAAAAATAGCAGAATCTCTTTTAAATAATGAAAAATGGACATCTATTTTATTGGACAGGTTAAAAACAGCCAAGAAACTTCTAAGCAGACGAGGTGCACTGAAAAGCGCCGAAAGAGTAGAAGTACTTCATCGGTTGAATAAACTCAAGGAGGCTCCTCTTCCCCACCATCCGAGCCTATTTGATAATTTTAGTGGAGGAAAAACATCAGCAGTATCTGCTGGAACAGTCATCGCATCAGATATGCATTTCAAATTGGTTGAACATATTTTTAAGGTCTCCTTTAGAAAATGGGGTCCCTGTGGAGATAAAACTGAAAGCGGGGAAGAAGAAGATGAGGAAGAAGAAGAAGAAGAAAAGAAACATTCCATATCAAGATTCGTGCTTCAATTTATGAACGGACACAACGGGCAACATTATCATAGGCCCGAAAGTGCTTCTGTTTACTTTTGTGATTATTATGACTATTTGGCCTACAGGAATCTCCCTAATGAGTACAAATTATCGTCAATGCATCCTGGCACATTCAATATGGAGGATTTACCTTTCCGCCCTTTCGCAGTACCTTCAACTTATAAGACAGAATTAGAGTACAAAAGGTTTGTGCAATCAACAAATCTTCCCCAGCTAAGTTTCGACTATGGGGAGTTTTTATGTTACTGTATCTTCGGAGCAGATTGGTACAAACACCTGGGGGATGTGGTAGATTCTCTAGAAAATAGTTCCATGATATCATTTGATTCTCAGACATTGAGTGGTGTGTATAAGAACACTGCTAATTACAAAAGGTTGGGGAAGAAAAGAAACGGAATAGCCGATTTGGCCGTTAGGAGTATGGCAGAATTTATCCGCACTGAAGCGCATAAGGCATTGACAGCAGAAGAGATGGAAGAAGAAGAAGAGGAAGAAGAAGCGGAAGAAGAAGCGATGGACCAGGAGCCTGCAGAAGTAGACTTCCTTTCAGTGCCTCATTTACGCCGTAAAATTCGTCAAGCTGTTTCTGTGTTAAATAACTTTGTGGAGAACGATCTTTCTATATTGGTTTCTAACTTCAAGAATGTGTTAACCGATGATACTGTATCAGGAACAGATACGGACAACTTTGGTTCTAGTGGAGAATTTGAAGCATTATCTTCCCATTTATTCCTTTCAAGAATATTGGATGAAGTGCACATTCTTAGGAATACTGATATACAAAGAACCCTATTTTCAACGCACGTGTCTCTGTCGGATAAATCTCCCCCTAGCCGTGTCCGTGGAAGCAATGTCAACTTTAATAATAACGCTGGGAACATTTCTTCCCTGCAAACGTATGGCGGTATAGAAGAGTTGCCTGAAAATGTACTAGTCGGTTTGTCCGGAGGATTTGAAGATACCGACATGTATTCCGGAGAGGATGTTGTTGTCGTATGGGATGGTTGTGATGGAGGAAAAGTGCTAAGTGTCACCTTCAATTGTGGTGATAATTTTATCCAGCTCCATGAAAAAACAGCAGAAACTTTTAAGGATGATACGGATTTAGTTGAACGAATAAGAGATGTGCTTCAGACTGCAAGTAAGACCGGAAACCTTAACAAAAAAGCATATTCAAGGAAGAACATCTACGCTGTTTTGCGTGAAAATGGCATTGAGCGCCCCGGGGACGATTTTACAGAAAAGGGGATTGCTCTCAAGGATAAAACAAATCAACCCCCTCCCCCTGCAAGAAGTGCCAAGATAACGGTTGAAGGAGTCAAGGGATTTTTCAGCGGTTTTCGTGACATTTTGGAGACGAGGGCGCTCACCACATATAGTGCAGAAACCTTCAGAGATTTAGGCCAAGGCATAGTAAAAGAGACCGAAGGACTGACAGCTGCAACAGTGGCAGAAACATCCTTCTCTGAAGGTTTAGCTGAAAGTTTAAGGTCTGATGCGAATCTAGGTCTAGAATTTTCAGAGGACGCCAAAACGGTTGTATTCAAAAATGACACCTCTCGTTCTTTATTGGAAGAAACTAGGGCATTAAGAGCAAACAATACTTCTTTTTCGTCGTTTGCAAGGGACATGGGCGTCCAAGTTAGTGCCGATTTAGATGCTGAATTTGCTGCAGAGATGAGAGAAACATACCCCGATGCAGCCCTTGAACAAAACTTGAAAGATCTCGACAAATTCGAAGAGACTATACCAGAAAGTCAAGTGAAGAAACTAAAGAAAATAGACAGTTATTTGACAGAGAATCCAGAAAGGGCTGGCAAAGAAATTAACGACACTGAACTGTCAAAGGCTACAGATTCAGTATTGGGGAAGAAACTAGGCAATGCAGTTACAGTGTTGATGAACAACTTTGGAAAGGTTACAATTGTAGTAGGGGCTTCTGTGGTGGCCGGGTTTTTAGGTCCAGCCGCTGTCGCCCTGGTGCATGCGTCCAGAGGGGCACATCTCAACGTCGTGGACCACACCAGCCCTAAAGGTGTCATCAGTTATAAAATTGTGGACTTTTCTTGTGCAGATAGAAACACCGGATGGGCTAAGCCAACCAAGCACCCGTTCAGGGAAGAAATAGACCATGTTATCGCACTAGATGCATCATTCTTAACTGAAAATGGAGCATATGTATTCCCTGAAGACGGAGGACCCAAATCGAAATATAAGGCCTACGCACCAATCTGTGGAACAAAAGATGCTGCTCAAGGAGAATGTGGATCTTGGGCAACATTCGACGACCCGCATTCTGTATTGCCTTGGGTGGCAAGCATGAAAGATTTGCCTAAAGGACAATCCCTCTCCTGCGATAAAGGGATGTCCACTTTAAAGGCAGTTTCTTCCGTTCTTTTGTCCATAGGAAAGGATGTTGCAGAGGCTATTTTTGAGGTTGCAGAGGACGCCGTGGTGGGGTTGGCGAGCAAGGCAATTTCAGCTGTAATAAATAACCCCTTGTTCATATTTGGAGTGCCTCTTGGATTTGGTATAGCTGCTACACGCCTCAATCCATCCAACTGGAAAACTGGCCTCATTGTATTTTCAATACTACTAGTGGTCATACTGATAGTTCGCTTCTTTGCAGGGTCGGGCCCGCTAACCCTGAATTGGTTTGGTGCAAAGAATTCAGCTAAAAGGAAACAGACTGAACAATTCGAAGACGGGGGAGGAAATCGTTCAAAAATAGTATTGGCAGAAAAGGACAACGCCAATAGTAAACTTCAATCGAGGAGGAATGAAACTGGGCCCATGAGATTAGAGGAGCTTCCTGGGCATGAAGATTTGCGCCCAGTTTTCTTCCCTGCCACAACAAATTATTCCAAATCTGCCAAGATTCTGGGCTACAAATCTAAACCCTTCAACGACTTTTATACAAAAATAATAAACACAGACATCATAAAAATGGATAGGTAA

SEQ ID NO: 28 - protein, 968 aa, Artificial Sequence
  Whispovirus wssv. >P5MICT165005 (VP53B)
MATFTEQDHKNAFLYANEKLRQERIYRLKMSEPSVYAFIDIKEIENGWEKEFGLLVQPGQKLAPFRDISYDSSKLDCDAFSCIPSDILHSDNEKRVGECNFAEHTSVSFPVKNPEGKTLRHFTACGPGCYRRYKQRDPHTGLPVARGVLMQDHVDHETGNKMCEYLNQSLVMWAAVPWIRPGDLTEGYNTTHVPGFAFKEDDERDSKRVKYENVVISKAYCDFFKQYYDADSGSCYRSGWMKFVHLMFGQYFTNLSYNLANPKPYNLTGNTWSDVVSVLTDNPIVDAGAAPSRSEMDEIITKKKFNVFPSEQTSARQKAENIIRSQYGDGVEIDPSSVDALMQFVNREGVVGTEKKSDRLMRVADAVMDAAMRLQVMGLDDSQSRRLLLKNMIKMSRNNPEYARHFSSSLKLIGVTLAIKRSVFSKGASAKRKETAINNGEQHRRSRWSPETVTEEDALLFARENITEDPKHPAPFVDILHSPDINSSIKSGSSSSIWNDILSRISSTRKLEEKASVFVKNLVVKVVRQFLDILEGKLFSDGYEWDDNIPLMIGVDQILREVIKAASNMCARFASSALESSLVTGFIDSASAITSRLAVQLAARTFSVFLEESVIEFVVAASLRLAIQAFADLATLAASALTVIGIVIFVIQVLGLILDLALGLGWYDHIFSPEDLKKQVLVFRREFAKAGNVDVGVAQPVTPEEIVAINVFLQTEENGEEKKEEGARKSKIDFLQKYFHSTPLMGKKSKFVYIQEAAQEYLGGRTMNAFGQRIITAADDSDTTTTTQEGRRDDETVTKKMRSIILETGQTLKDYSSAVNYNASRLDYVGEEWVRNTALKEETRSNTTSDNLFKKTVSLASMAGAFLVLGIGVLVASHITLLRFTNIGLAFAFAGLLAFIALMSISYINMNAMGVVNSDAIYRSTALVGDIKTDPRRVGMVQRHVGVGAKYNMITDFVSPMLDEIESD

SEQ ID NO: 29 - protein, 2907 aa, Artificial Sequence
  Whispovirus wssv. >P5MICG165005 (VP53B)
ATGGCAACATTTACTGAACAGGATCATAAAAATGCGTTTTTATATGCTAATGAGAAGCTGAGGCAGGAAAGAATATACAGACTTAAAATGTCTGAGCCTTCAGTTTATGCTTTTATTGACATAAAAGAAATAGAAAATGGTTGGGAAAAAGAATTCGGGCTTTTAGTACAACCAGGACAGAAATTAGCTCCTTTCAGGGATATTTCTTATGACTCAAGCAAACTTGATTGTGACGCATTTTCTTGCATACCTTCAGATATACTTCATTCTGATAATGAAAAAAGAGTAGGAGAGTGCAACTTTGCCGAACACACCTCTGTCTCATTTCCTGTCAAGAACCCTGAGGGAAAAACATTGCGCCATTTCACGGCATGTGGTCCAGGGTGTTACCGGAGGTACAAGCAAAGAGACCCCCATACTGGTTTGCCAGTAGCCAGAGGCGTCCTGATGCAAGATCACGTTGACCATGAAACTGGAAATAAAATGTGTGAATATCTGAACCAGAGCTTAGTCATGTGGGCTGCTGTCCCTTGGATACGACCTGGAGACCTTACTGAAGGTTACAACACAACACACGTGCCTGGCTTTGCATTCAAGGAGGATGACGAAAGGGATTCAAAAAGAGTTAAATATGAAAATGTGGTCATTTCAAAGGCTTATTGTGATTTCTTTAAACAGTATTATGACGCAGACTCTGGCTCATGTTATCGATCTGGATGGATGAAATTTGTCCATTTAATGTTTGGGCAGTATTTTACTAATCTTTCTTACAATTTAGCTAACCCAAAACCTTACAATTTAACTGGAAATACATGGTCTGATGTAGTTTCTGTATTGACAGATAACCCTATTGTAGATGCGGGTGCTGCTCCGTCCAGATCTGAAATGGATGAAATTATCACCAAGAAGAAGTTCAACGTATTCCCTTCTGAGCAGACATCTGCTCGCCAGAAAGCAGAGAATATAATACGTTCTCAGTACGGAGATGGTGTAGAAATAGACCCATCTTCTGTGGATGCTTTAATGCAGTTTGTTAATAGGGAAGGTGTAGTAGGAACAGAGAAAAAATCCGACCGCCTCATGCGAGTGGCAGACGCTGTTATGGATGCGGCTATGCGCCTTCAAGTCATGGGTCTGGACGACAGTCAATCTAGACGATTATTGTTAAAAAATATGATTAAAATGAGTAGAAACAACCCAGAATATGCAAGACATTTTTCCAGTTCTCTCAAATTAATTGGAGTAACTTTGGCCATAAAAAGATCTGTTTTCTCTAAAGGCGCTTCAGCTAAAAGAAAGGAAACGGCCATTAATAATGGCGAACAGCATAGAAGAAGCAGATGGTCACCCGAGACGGTGACAGAAGAAGATGCACTTTTATTTGCAAGAGAAAATATCACTGAAGACCCAAAACACCCTGCGCCCTTTGTGGACATTTTACACTCACCAGATATCAATTCATCTATCAAGAGCGGTTCTTCTTCCTCAATATGGAACGATATACTTTCAAGAATTTCTTCGACCAGAAAACTGGAAGAAAAGGCGAGTGTTTTCGTTAAAAATCTTGTGGTGAAAGTAGTGAGACAGTTCTTGGACATTTTAGAAGGTAAACTGTTTTCGGACGGATACGAATGGGACGATAATATTCCTCTGATGATAGGCGTGGACCAAATATTGAGAGAAGTCATTAAGGCGGCCAGTAATATGTGCGCTAGATTTGCCTCCTCAGCTCTGGAGTCTAGTTTGGTTACTGGCTTTATAGACTCGGCGAGTGCTATCACTTCTAGGTTAGCCGTACAACTGGCAGCCAGAACGTTCTCCGTATTCTTGGAGGAGTCTGTTATAGAATTTGTAGTTGCCGCAAGCCTTCGGCTAGCGATACAGGCATTTGCCGATCTGGCAACTCTTGCCGCGTCAGCCTTAACCGTTATTGGAATTGTTATATTCGTAATACAAGTACTTGGGTTGATTTTGGATCTTGCGCTAGGGTTAGGTTGGTACGATCACATTTTTAGCCCAGAGGATTTAAAGAAGCAGGTTCTAGTGTTTAGGAGAGAGTTTGCAAAGGCAGGAAATGTAGATGTGGGTGTAGCTCAACCAGTCACCCCTGAAGAAATCGTCGCTATCAACGTTTTCCTTCAAACTGAAGAAAACGGGGAAGAAAAGAAGGAAGAAGGAGCACGAAAATCAAAGATTGATTTTCTTCAAAAATACTTCCATTCTACTCCTTTGATGGGAAAGAAAAGTAAGTTTGTCTACATACAAGAAGCAGCTCAAGAATACTTGGGAGGAAGAACAATGAACGCTTTTGGGCAGCGTATAATAACAGCTGCTGATGATAGTGACACCACCACCACCACACAAGAGGGAAGGAGGGATGACGAAACAGTGACTAAGAAAATGAGGAGTATTATTCTAGAAACAGGTCAAACTCTTAAGGATTACTCGTCTGCTGTTAACTATAACGCCTCCCGTCTAGATTACGTGGGAGAGGAATGGGTAAGAAATACTGCCCTAAAAGAAGAGACAAGGAGCAACACTACTAGTGATAACCTATTCAAGAAAACTGTTTCTCTTGCTAGTATGGCCGGCGCATTTCTGGTTCTAGGAATAGGTGTATTGGTAGCGTCCCATATTACACTTTTACGTTTCACCAATATTGGTCTAGCTTTTGCGTTCGCAGGTCTCCTAGCATTTATTGCACTTATGAGTATATCATATATAAACATGAATGCTATGGGTGTAGTGAATTCGGACGCAATATACAGGTCTACTGCTCTAGTTGGAGATATCAAAACAGACCCCAGAAGAGTAGGAATGGTCCAGCGCCACGTAGGTGTCGGGGCTAAATACAACATGATTACAGATTTCGTCTCTCCAATGTTAGACGAGATCGAGAGTGACTAA

SEQ ID NO: 30 - protein, 489 aa, Artificial Sequence
  Whispovirus wssv. >P5MICT165159 (VP53C)
MESVRDVKFYTFMNVLAEKAKKIQRLNKDKGWRTSINAEIGYGGARLMDVRFTGRKSMDELARCLYNCDGEYTTLRLVGSSAGNIIVYSLAFIMGIRGECCGFNVNNRLRMGKIIDRELFYKITGLNFPETVKCTCDGVRAICDLFLEVAALQEHPAWHETKEVGKKQQQHFNEFGSQYPGTKFNKRHKLSTKIIQQMFSEEKTMEQVLAFSEGTAASGFSDLYVEAPIQYVVNMYRAISNMEGRVGAMYNLSRVLILLCSRWEKKPGYKNDFYSKCEMYIGSKKIVDDESFIFTDLITGDLVPLVRLAPSNEDIQRDVIRFNDSTDILMDSIDVRDVVLPVLSKIIWQNVSARLKLRNNKSLSKLAKWKWNGMVSTHDNFDSNDYVIEHKRQLAADIMSDSLSKNHLPNFSKTITEYDEKENKTTPLICWNYIFELSPMGKHLFPLEEVCGFYEASLPLITPWQLKVVQKKRGRQMVIYGPRKRPRTQ

SEQ ID NO: 31 - protein, 1470 aa, Artificial Sequence
  Whispovirus wssv. >P5MICG165159 (VP53C)
ATGGAATCTGTAAGAGACGTTAAATTTTACACTTTTATGAATGTATTGGCAGAGAAGGCGAAAAAGATACAGCGCCTAAACAAGGATAAAGGTTGGAGGACTTCAATAAACGCTGAAATTGGATATGGAGGAGCAAGACTCATGGATGTGCGCTTCACGGGCAGGAAATCAATGGACGAATTGGCAAGATGTCTCTATAACTGCGATGGAGAATATACAACTCTTAGACTCGTGGGTTCAAGTGCGGGAAATATTATAGTATATTCTTTAGCCTTTATAATGGGAATCAGAGGCGAGTGTTGTGGGTTTAATGTCAATAATCGCCTACGAATGGGAAAAATAATAGACAGAGAGTTGTTTTATAAAATAACAGGATTAAATTTCCCTGAAACTGTAAAATGCACATGTGATGGAGTACGAGCCATCTGTGATTTGTTCCTGGAGGTGGCTGCTCTTCAAGAACACCCCGCCTGGCATGAAACTAAAGAAGTAGGGAAAAAACAACAACAACATTTCAACGAATTCGGGTCCCAGTACCCTGGCACAAAATTCAATAAGCGGCACAAACTATCCACTAAAATAATTCAGCAAATGTTTTCAGAAGAGAAGACTATGGAACAAGTTCTAGCCTTTAGTGAAGGAACTGCCGCTAGTGGATTTTCAGATTTGTACGTAGAAGCACCTATACAATACGTGGTTAATATGTATAGAGCTATCAGTAATATGGAAGGAAGAGTAGGTGCCATGTATAATTTGTCGAGAGTTTTAATACTCTTATGTTCTAGGTGGGAAAAGAAACCAGGGTATAAAAATGACTTTTATAGTAAGTGTGAGATGTACATAGGCTCCAAAAAAATTGTTGATGACGAGAGCTTTATTTTCACCGATCTCATAACTGGGGATTTAGTTCCTCTAGTTCGATTGGCCCCATCAAACGAAGATATACAGAGAGATGTTATAAGGTTCAATGATTCTACTGATATATTAATGGACAGTATTGACGTGAGGGATGTTGTTTTGCCTGTACTTTCTAAAATAATATGGCAAAACGTTTCTGCACGTCTAAAATTGCGCAACAATAAATCCCTCTCCAAACTAGCCAAATGGAAATGGAATGGTATGGTGTCAACACACGACAACTTTGATTCGAATGATTATGTCATTGAACATAAACGTCAACTTGCAGCGGATATAATGTCCGATAGTCTATCAAAAAATCACCTTCCAAATTTTAGTAAAACAATAACGGAGTACGATGAAAAGGAAAATAAAACAACACCCTTAATATGTTGGAATTATATTTTTGAATTGTCCCCTATGGGGAAACACTTGTTCCCTTTAGAGGAAGTTTGCGGATTCTATGAGGCGAGTTTACCTCTCATAACACCATGGCAATTAAAGGTTGTCCAGAAAAAGAGAGGAAGGCAGATGGTCATCTACGGTCCTAGAAAACGACCTCGCACACAGTAA

SEQ ID NO: 32 - protein, 486 aa, Artificial Sequence
  Whispovirus wssv. >P5MICT165128 (VP51A)
MFVISIATSLVLFFFLLFVSITILDGAKTIDSQPFRKRRKRKRYRTSESGDGIDGGTGTTNGGGGGGGEGGGGGTNGNGTGTTNGGGGGGEGGGGGTNGNGSGTTNGGGGGGEGGGGGTNGGGNGNGGGNGNGNGNGGDTDTDDFEPTPALLKERLLNSISSKPKEYYEAFVSAEVETALQLSRDDSTQTIIIDDDQLELDASDTLQGKPRDYLFKLAGVSSAFLEGTTIRKAEDRARNINEEEIAQTILSQLREKHINDEYDGKYATPEERADFSNSLNLVTKYTNHEVGLLVGETIEKAFPHEIEFERCIILVEDFNSGTITSNTMQYRSNAYKIRVVEGSTTDPGEVVPDDCLVFAVVVNKEQHSLEISATNRCQDICFVIIPRLSAIGKNATMVIRKGDEIKQETYLFVANKNDTTHFSIITDKDESVGIELNMLIFSERILPTLSDPATVPRPLTDANVLSAYGKRLGVGAFTDKNLLSSQ

SEQ ID NO: 33 - protein, 1461 aa, Artificial Sequence
  Whispovirus wssv. >P5MICG165128 (VP51A)
ATGTTCGTCATAAGCATAGCTACGTCATTGGTGTTATTCTTCTTCCTTCTTTTCGTCTCAATAACAATTTTAGATGGTGCAAAAACAATCGACTCTCAACCTTTTAGGAAAAGGAGGAAGAGGAAGAGATATCGTACCAGTGAGAGTGGTGACGGCATAGACGGAGGAACTGGAACAACAAACGGAGGAGGAGGAGGTGGAGGAGAAGGAGGTGGTGGTGGAACAAATGGAAATGGAACTGGAACAACAAACGGAGGAGGAGGTGGAGGAGAAGGAGGTGGTGGTGGAACAAATGGAAATGGTTCTGGAACAACAAACGGAGGAGGAGGTGGAGGAGAAGGAGGTGGTGGTGGAACAAATGGAGGAGGAAATGGAAATGGAGGAGGAAATGGAAATGGAAATGGAAATGGAGGGGATACAGACACAGACGATTTTGAGCCTACGCCAGCCCTTCTAAAAGAACGTCTACTTAATTCCATATCTTCAAAACCTAAAGAATACTATGAAGCATTCGTATCTGCAGAGGTAGAAACTGCCTTACAATTATCTCGAGATGATTCTACCCAAACTATAATAATTGATGACGACCAATTAGAATTGGACGCCTCAGACACTCTACAAGGAAAACCAAGGGATTATTTGTTCAAGCTCGCAGGTGTTTCATCGGCCTTTTTAGAAGGTACCACTATCCGCAAAGCGGAAGACCGTGCCCGTAATATAAATGAGGAAGAAATTGCACAAACAATATTAAGTCAACTAAGAGAAAAACACATCAACGATGAATACGATGGAAAATATGCCACACCCGAGGAAAGAGCTGATTTTTCCAATAGTCTTAATCTTGTTACTAAATACACAAACCATGAAGTGGGTCTTTTAGTAGGAGAAACTATTGAAAAGGCTTTCCCTCATGAGATTGAGTTTGAGAGATGCATAATTCTAGTAGAGGATTTTAATAGTGGAACTATTACTTCAAACACTATGCAGTACAGGTCCAACGCTTACAAAATCAGAGTAGTAGAAGGATCAACAACAGATCCAGGGGAAGTTGTCCCTGATGATTGTTTGGTTTTTGCCGTAGTAGTAAATAAGGAACAACATTCTCTAGAAATATCTGCAACTAACAGATGCCAAGACATATGCTTTGTAATTATTCCTCGTTTATCCGCAATAGGAAAAAATGCTACCATGGTAATAAGGAAAGGTGATGAAATTAAACAAGAAACCTATCTGTTTGTGGCCAATAAGAATGACACTACTCATTTTTCAATCATCACAGACAAGGATGAATCTGTTGGAATAGAATTAAACATGCTCATTTTCTCAGAAAGAATTCTCCCCACTTTGAGTGACCCTGCAACCGTTCCAAGACCTTTGACTGACGCCAACGTACTGTCAGCCTACGGAAAGCGCCTAGGTGTTGGTGCCTTTACAGACAAAAATTTATTGTCCAGCCAATAA

SEQ ID NO: 34 - protein, 384 aa, Artificial Sequence
  Whispovirus wssv. >P5MICT165146 (VP51B)
MIFYTMQPFLGFLVFSVLIVIVMTVLAVYTAPQIKKSKKRKIEDENEEEPVKTLEDFVKGRLLNAVKEKPAEYFELLISADTEAALKTAEETALRDFVIENDSVEIDVEEVLEEKPREYVFKLAGATSETLTNTIIAEVQKKAALITEEDITIKMLKQFRAANKDNKDGEATPEEKEDFTNNSDLVGLYLNEVVEKTTNIVINKIFPHEMVFERCAILIEDFDTGVVTDQAIQIPSNKYKIRLVEGDEPEVFPGDCLDLAVSVDKINHVLKISAKNGCENNCFVIIPRFSPVGSVSSMILGSTDQVKPKTFLFLANKNDSTHFQFTMDKQHSVGCELDMLIFSERNLRNLPDSKPRPLSDADILASYGKRLGTGVFTTENLVDD

SEQ ID NO: 35 - protein, 1155 aa, Artificial Sequence
  Whispovirus wssv. >P5MICG165146 (VP51B)
ATGATATTTTATACAATGCAACCCTTCCTTGGGTTTCTGGTCTTTTCTGTGCTTATTGTAATTGTAATGACTGTATTAGCTGTATACACTGCACCTCAAATAAAGAAATCGAAGAAGAGAAAAATTGAAGATGAAAATGAGGAAGAACCCGTAAAGACTTTGGAAGATTTTGTAAAGGGTCGGCTCCTTAACGCTGTCAAGGAAAAACCTGCAGAGTACTTTGAGTTGCTAATATCTGCAGACACTGAAGCAGCATTAAAAACTGCCGAAGAAACAGCCCTTCGAGATTTTGTTATTGAGAACGACTCTGTCGAAATAGATGTGGAGGAAGTACTTGAAGAGAAACCAAGAGAATATGTCTTCAAATTGGCAGGCGCAACAAGCGAAACGCTAACAAACACAATCATCGCAGAGGTACAAAAAAAGGCAGCATTAATAACAGAAGAAGATATCACTATTAAAATGTTAAAACAATTCAGGGCTGCGAACAAAGATAATAAAGACGGGGAAGCAACTCCTGAAGAAAAGGAAGATTTTACCAATAATTCAGATCTTGTGGGGTTGTACTTGAACGAAGTAGTAGAAAAAACAACAAATATTGTCATTAACAAAATATTCCCTCATGAGATGGTTTTTGAAAGATGTGCTATTTTAATTGAAGATTTTGATACTGGTGTTGTGACTGATCAAGCCATTCAGATACCCTCCAACAAATACAAAATCAGATTAGTCGAAGGGGATGAACCTGAAGTATTCCCTGGTGACTGCTTGGATCTTGCAGTTTCAGTTGATAAAATAAACCACGTCTTGAAAATTTCTGCAAAGAACGGATGTGAAAACAACTGCTTCGTTATTATTCCACGGTTCTCTCCTGTAGGAAGTGTTTCTTCCATGATATTGGGCAGCACTGACCAAGTCAAACCTAAAACATTCTTATTTTTAGCCAACAAAAATGACAGTACACATTTTCAATTCACAATGGATAAGCAACATTCTGTAGGGTGTGAGTTGGACATGTTAATTTTTTCAGAAAGGAACTTGAGGAATTTACCCGATTCAAAACCTAGACCTCTAAGTGATGCAGACATATTGGCCTCATATGGGAAGCGTCTAGGAACTGGTGTTTTCACAACAGAAAATTTGGTAGACGATTAA

SEQ ID NO: 36 - protein, 82 aa, Artificial Sequence
  Whispovirus wssv. >P5MICT165120
MATFQTDADFLLVGDDTSRYEEVMKTFDTVEAVRKSDLDDRVYMVCLKQGSTFVLNGGIEELRLLTGDSTLEIQPMIVPTTE

SEQ ID NO: 37 - protein, 249 aa, Artificial Sequence
  Whispovirus wssv. >P5MICG165120 sequence_region_id=4491 start=126755 stop=127003 length=249
ATGGCCACCTTCCAGACTGACGCCGATTTCTTGCTGGTGGGGGATGATACTAGTAGATATGAAGAAGTGATGAAGACTTTTGATACTGTTGAGGCAGTCAGGAAGAGTGATCTAGATGACCGTGTTTACATGGTGTGCCTAAAGCAGGGATCTACTTTTGTCCTCAATGGAGGCATCGAAGAATTGCGTCTTTTGACTGGAGATTCAACGCTGGAGATTCAACCCATGATTGTGCCAACAACAGAATAA

SEQ ID NO: 38 - protein, 615 aa, Artificial Sequence
  Whispovirus wssv. >P5MICT165121
MEYIGEKNNNPVSNESVSEKELKLRSSFLMIGKKTSKYEQVMGVYEAIESIRQSELSEDTFVVHVKKDKQLKFARGLKRLQELVEDDSLRIERISCAPPEPGHLFKDDAGHVTDEEWLATQEEDVRKINTIVKEKLKRKDKDFKFSQLYRYMSNSLSEAVEKKHDCMIISSDFLIGLGFSTMNVTHALKSMERTMQKHGFKDMMVPLVEICHRTHYKGEYIANPIFKSHSSHCLIVPLFMVAGVFARSAHPSAASIEMYLSTLAYAVILYSDEKQRQIREELARKNLQIKEELENQVEKTTKVEKELETQVVKTTKVEKELETQVVKKEEYKNSYIETEQLFKVSEEQKESLRNVHKKSSNATFRYDSGSCLVFSISSTEFYLLCRTDKSGSFETATENGLRYIFSPINKKRDTAGMRPRLIMAVTGCDAPIACNDSIKHQNKFKVLKCNRSSIVFQTPPSDEDLKGIVQKVTGSDIRIFMNDGTVYQDGQRIDISSPQELDEENMTQFEIEQQRKLHSMMENTSKIVTRYNKERHLTTKEARTRNKTEKWFEKVKKREEQKKRENGEQSTSEQEQRGVKRTWENDNEFDSDVEEEEDGNNTQEQQRVKRHAISV

SEQ ID NO: 39 - protein, 1848 aa, Artificial Sequence
  Whispovirus wssv. >P5MICG165121 sequence_region_id=4491 start=129006 stop=127159 length=1848
ATGGAATACATTGGAGAGAAAAACAATAACCCTGTTAGTAATGAAAGTGTATCAGAAAAGGAGTTAAAACTAAGATCGTCATTCCTGATGATCGGGAAGAAAACAAGTAAATATGAGCAAGTCATGGGTGTTTATGAAGCTATCGAATCTATAAGACAAAGCGAATTGTCCGAAGACACATTTGTTGTACATGTGAAGAAAGATAAACAACTCAAATTCGCAAGAGGGTTAAAAAGATTACAAGAATTGGTAGAAGATGACTCTTTAAGAATTGAACGGATAAGTTGTGCCCCTCCTGAACCTGGACATTTATTCAAAGATGATGCTGGGCACGTTACTGACGAGGAATGGCTTGCAACGCAAGAAGAAGACGTGCGTAAAATCAATACAATAGTCAAGGAAAAATTAAAACGAAAAGACAAGGACTTTAAATTCAGTCAATTATACAGGTACATGAGCAATAGTCTTTCTGAAGCAGTAGAAAAAAAACACGATTGTATGATAATAAGTTCCGATTTCTTAATCGGTTTAGGTTTCAGTACAATGAACGTCACGCACGCTTTAAAGTCAATGGAGAGAACTATGCAGAAACATGGTTTCAAGGATATGATGGTCCCATTGGTTGAAATTTGTCACCGTACCCATTACAAAGGAGAATATATAGCCAATCCTATTTTCAAGAGCCATTCTTCACATTGCTTGATTGTTCCCTTGTTTATGGTGGCGGGCGTTTTTGCAAGGAGCGCACACCCTTCTGCTGCAAGCATTGAAATGTACCTTTCGACACTAGCCTACGCTGTTATCTTATACAGTGATGAAAAGCAACGCCAGATACGCGAAGAGTTGGCTAGGAAAAATTTACAAATAAAAGAGGAACTAGAAAACCAGGTCGAAAAGACCACAAAAGTTGAAAAGGAACTAGAAACACAAGTAGTAAAGACCACAAAAGTTGAAAAGGAACTAGAAACACAAGTAGTAAAGAAAGAGGAGTACAAAAACTCGTATATCGAAACTGAACAACTTTTCAAAGTCTCTGAGGAACAAAAAGAATCTCTCAGAAATGTACACAAGAAATCTTCCAATGCGACCTTCAGATACGACAGCGGCTCTTGTCTCGTCTTCTCGATATCCTCTACAGAATTCTACTTGTTGTGCAGGACAGACAAAAGTGGTTCCTTTGAAACTGCAACAGAAAATGGTTTGAGGTACATTTTCTCCCCCATAAACAAGAAAAGGGATACTGCAGGTATGAGGCCCAGACTCATCATGGCCGTGACTGGCTGTGACGCACCTATCGCTTGCAACGACAGTATCAAACACCAAAACAAGTTCAAGGTATTAAAATGTAACCGATCAAGTATAGTTTTCCAGACCCCTCCAAGTGATGAAGATTTGAAGGGTATTGTACAAAAAGTGACAGGTTCTGATATCCGAATCTTTATGAATGATGGCACCGTCTATCAAGATGGGCAGAGGATAGACATCTCTTCGCCTCAAGAACTTGATGAAGAAAATATGACCCAATTTGAAATTGAACAACAAAGGAAGCTCCATTCCATGATGGAGAACACATCAAAAATTGTCACTAGGTACAACAAGGAAAGACATTTGACCACAAAGGAAGCTCGTACGAGAAACAAGACCGAAAAGTGGTTTGAGAAGGTAAAGAAGAGGGAGGAACAAAAGAAGCGAGAAAATGGAGAACAGTCTACCAGTGAACAGGAGCAAAGGGGAGTAAAAAGGACCTGGGAAAACGACAATGAATTTGATAGCGACGTAGAAGAAGAAGAAGATGGAAACAACACTCAAGAACAACAGCGTGTAAAGAGACATGCCATTTCTGTGTAA

SEQ ID NO: 40 - protein, 294 aa, Artificial Sequence
  Whispovirus wssv. >P5MICT165124
MEYIGEQKLINLLDETPEEDELQLRSSFLMIGEKQYEKYEEVMSTFEAVETIRKSEFRDGVFIVQLKENKHITFEGGLKELRELTGDNSLKIESLLSSIKPEKGHVILKNTSTTTDDEWLASQDKDVQEVNKLVKEKTRMLFRGFYFSPTYRYITKSLPQIPFGEKERFVVSTDFLIGLGFSADDVMEKLIAIEGNMRKSGLKYTWVPVAEVCHLKKYKGDIVVNPIFKSYHSHCLVIPLVYLGYMFSRNVQPPSLEVETYLLALAFAIDLYGREEMRKSCMRLCEDISEVKRG

SEQ ID NO: 41 - protein, 885 aa, Artificial Sequence
  Whispovirus wssv. >P5MICG165124 sequence_region_id=4491 start=130290 stop=129406 length=885
ATGGAGTATATAGGGGAACAAAAACTGATAAATCTCCTGGATGAGACACCTGAAGAAGACGAGTTACAGCTACGCTCTTCTTTTCTAATGATTGGAGAAAAACAATATGAAAAGTATGAAGAAGTAATGAGTACATTTGAAGCAGTTGAAACTATCCGAAAGAGTGAATTTAGAGACGGCGTTTTCATTGTACAATTAAAGGAAAATAAACACATTACTTTTGAAGGGGGACTGAAAGAATTAAGAGAGCTCACAGGGGACAATTCCCTCAAGATAGAATCATTATTATCCTCTATTAAGCCTGAGAAAGGACACGTTATACTTAAAAACACGTCTACAACTACTGATGACGAGTGGCTTGCTTCTCAAGACAAAGACGTACAGGAAGTAAATAAGCTCGTAAAGGAAAAGACACGGATGTTGTTTAGAGGGTTTTATTTCAGTCCAACTTACAGGTATATAACAAAAAGTCTTCCTCAAATACCTTTCGGGGAAAAGGAACGTTTTGTTGTTAGCACAGATTTTTTGATTGGTCTCGGTTTTAGTGCTGATGATGTCATGGAAAAATTAATAGCGATAGAGGGAAATATGCGGAAAAGTGGTCTGAAATATACATGGGTGCCTGTGGCCGAAGTGTGCCATCTCAAAAAATACAAGGGTGATATTGTTGTAAACCCCATTTTCAAGAGTTATCATTCCCATTGCCTAGTTATTCCACTGGTGTATCTAGGGTACATGTTTTCCCGTAATGTTCAACCCCCATCTCTAGAAGTGGAGACGTATCTGTTGGCGTTAGCGTTTGCTATTGATTTGTACGGCAGGGAAGAAATGCGCAAGTCTTGCATGCGATTATGTGAGGATATTTCTGAGGTGAAAAGGGGGTAA

SEQ ID NO: 42 - protein, 221 aa, Artificial Sequence
  Whispovirus wssv. >P5MICT165127 (VP41A)
KALVVFDKLVEETDSGQSVPPTLSGSDYDAWVDRAMPSHIELVESVEGDSLYDKLPPFNVQDIDDQIGDEIDTPISYLAMVVVKVDCETGDIEEEYNLAPTFGVTQNNKIYRDERDQIFTKADKSVRIFKLAKLDSISGKSRQLTYAVKNNNEYTEFVCSVFAEFESDSDTTKSGIGIREYDKPKNEFEYEEREIFTFFIPIQPAGTKLLLYFLVDVRSRI

SEQ ID NO: 43 - protein, 879 aa, Artificial Sequence
  Whispovirus wssv. >P5MICG165127 (VP41A)
ATGTTGTTTGATTTCTTTCTAAAAATGGCTGCTGCAAAAATGGACGCTATCCTTGCGGATATTAATGGGAATGATACAGATTTATCCAAGCTAATCACAGACGTGATTCAAAAGAGAGCCAAGGCTGTCATGGATAGAAATAGGGCTAAAATGGACATGAATAGAAGAGTAGATGAGGCTATTCAGGAAGCCGTAGCGGCCAAGAAACAAAAAGCATTAGTGGTATTTGATAAACTCGTGGAAGAAACTGACAGCGGACAAAGTGTCCCTCCAACATTATCGGGATCCGATTACGACGCGTGGGTAGACAGAGCCATGCCTTCGCATATTGAACTTGTAGAGAGTGTTGAGGGAGATTCTTTGTATGATAAACTCCCTCCTTTTAACGTACAAGACATAGACGACCAAATCGGTGATGAGATAGATACACCAATATCTTACCTTGCCATGGTAGTGGTAAAAGTCGACTGTGAAACTGGGGATATCGAAGAAGAGTACAATCTTGCTCCTACCTTTGGTGTGACACAAAATAATAAAATATACAGAGATGAAAGAGACCAGATTTTTACAAAGGCTGATAAATCTGTGCGTATTTTTAAACTTGCTAAATTGGATAGTATATCAGGTAAAAGTAGACAACTGACGTATGCGGTAAAAAATAACAATGAATATACAGAGTTTGTCTGTAGCGTCTTTGCAGAGTTTGAATCTGACAGTGACACTACTAAATCAGGTATAGGTATTCGTGAATATGACAAACCTAAAAATGAATTCGAATATGAGGAGCGAGAGATCTTTACATTTTTTATTCCAATACAACCCGCAGGGACGAAATTATTGTTATACTTTTTGGTGGACGTCAGGTCCCGTATTATATAG

SEQ ID NO: 44 - protein, 240 aa, Artificial Sequence
  Whispovirus wssv. >P5MICT165132 (VP41B)
KVEEMRPDIINEASETYDKLAADMIREVDTSSVIAPAIAGTVARTINNLRDKRKEYEKRLWTLAYKPWRRYVQAITVMEFRLSYKDLTVHANSDTYLTFPFLRIKKIAYINNDRASPVNCSLSVSYPNKSEWGNDNGVGRKVDIHIRRNDLQEKDLYLSVICMLDTDFSGYDKAVEVDAHKFHFEAGNRTMFLPKTSNLFNRSHIVNSKICTIVFPPASASSASTTELDNVYYRITCTCS

SEQ ID NO: 45 - protein, 903 aa, Artificial Sequence
  Whispovirus wssv. >P5MICG165132 (VP41B)
ATGGGAGATAAGCAAAAGGTGGAACAGCTTTTAAGGGAATTAAAGGCAGAGGCTAATGATGATTGGCTATCGGCTAATGTTGATCCAATTGTTGAGAGATTTGTCACAACTAAATCTGATGAGACAGCCCAAGTTGTTAAACAGGCCGTTGATGAAAAATACGATGAATTATTAGAAGATAAGGTTGAAGAAATGAGACCGGATATAATCAATGAAGCATCCGAAACATATGATAAACTTGCTGCTGATATGATAAGAGAGGTAGACACTAGTAGTGTTATTGCTCCTGCAATAGCTGGCACAGTGGCAAGAACTATCAATAATTTAAGAGATAAAAGGAAAGAATATGAAAAGAGGCTATGGACATTAGCCTACAAACCATGGAGAAGATATGTACAAGCAATTACAGTGATGGAATTTCGTTTATCATATAAAGACCTGACTGTCCATGCCAATTCCGATACATATTTAACATTCCCTTTTTTAAGAATAAAAAAGATCGCCTATATTAATAACGACCGCGCCAGCCCCGTGAACTGCTCCTTGTCAGTGTCTTATCCCAACAAGTCCGAGTGGGGAAATGATAACGGAGTTGGACGTAAGGTTGACATACACATCAGAAGAAATGATTTACAGGAAAAGGATCTTTACCTGTCTGTTATTTGTATGTTAGATACTGATTTTTCAGGATATGATAAAGCTGTGGAAGTTGATGCCCATAAATTTCATTTTGAAGCAGGGAACAGGACTATGTTTTTACCCAAAACCTCTAATCTATTTAATCGATCGCATATAGTAAACTCTAAAATATGCACTATAGTGTTCCCTCCCGCTTCTGCCAGTTCTGCTTCTACAACAGAACTGGATAATGTCTATTACAGGATCACATGCACATGCTCCTAG

SEQ ID NO: 46 - protein, 419 aa, Artificial Sequence
  Whispovirus wssv. >P5MICT165197 (VP39A)
MSSTDLSKNAFHDWVVSKTDCEVFDVHCETDRDCGAACENTYSVDGKEVTKFSCNQQSGRCARSVYSASSLERAANDLGHIIGIIKKNPKLEEELPESFLWFINHNGGDLFVNKRAAYYDTMHLSIGKLDNVDTLAQGLDKRMASSLREHLLRKLDSILLQIDKVKYEKAKKWILDITQEAGTEEDNKEEEDAKKEDQSLSVSEIVDVLTGTHDPMPLRARGFIQKKIYPLSRNELRELALKELFPEETTSPQVLSRQHDVSTREDLCNESMNAGRAESIFSDPDSGEYVATCACLYSEYLTGPACKHKTYRYVIDYDKWKRTGRPEFLTDPVLHFKKAEAVCKSTNPNLRAIYSPDNKGFLCAPVAELVKTALTFRGSHEPSLIVERDINQAENLPSNSFGVNWPYVNLLNRIQDQYT

SEQ ID NO: 47 - protein, 1260 aa, Artificial Sequence
  Whispovirus wssv. >P5MICG165197 (VP39A)
ATGTCTTCGACTGATTTGTCTAAGAATGCCTTCCATGACTGGGTGGTATCAAAGACAGATTGTGAGGTGTTTGATGTACACTGTGAGACGGACAGAGATTGTGGCGCTGCTTGCGAGAACACGTACTCTGTTGACGGAAAGGAGGTTACAAAATTCTCTTGTAACCAACAGTCGGGAAGATGTGCCAGGAGTGTTTATAGTGCGTCTTCTCTAGAAAGAGCAGCCAATGATCTTGGCCACATTATAGGTATCATCAAGAAAAATCCAAAATTGGAGGAAGAACTCCCTGAATCATTTTTGTGGTTTATCAATCACAATGGAGGAGATTTGTTTGTGAATAAGCGAGCCGCGTACTACGACACGATGCATCTAAGCATAGGGAAACTGGATAATGTGGACACTCTTGCCCAGGGTTTAGATAAACGGATGGCCTCATCATTGAGAGAGCACCTACTGAGGAAGTTGGACTCTATACTTTTACAAATTGATAAAGTTAAATATGAAAAGGCAAAGAAATGGATATTGGATATAACACAGGAGGCTGGCACCGAAGAGGACAATAAAGAAGAAGAAGATGCGAAAAAAGAGGATCAATCTCTTAGCGTTAGTGAAATTGTGGATGTTTTAACGGGCACACATGACCCTATGCCCCTGAGGGCTAGAGGGTTTATCCAGAAAAAAATATATCCTTTGTCAAGAAACGAATTGAGAGAATTAGCCCTTAAGGAACTTTTCCCTGAAGAAACTACATCTCCTCAGGTTTTGAGTAGGCAACATGATGTATCTACGCGTGAAGATTTATGCAATGAAAGTATGAATGCAGGGAGGGCAGAATCCATTTTTAGCGACCCTGATTCTGGAGAGTACGTGGCTACTTGTGCATGTCTTTACTCGGAATATTTAACAGGGCCTGCGTGTAAGCACAAAACATACAGGTATGTTATAGACTACGACAAATGGAAAAGGACTGGAAGACCTGAATTTCTAACTGATCCTGTACTTCATTTTAAAAAGGCAGAAGCTGTGTGTAAATCGACAAATCCAAACTTGAGGGCAATTTATAGTCCAGATAATAAAGGTTTCTTGTGTGCGCCTGTAGCTGAACTTGTAAAGACGGCATTAACTTTTAGGGGTTCACACGAACCGTCTCTCATTGTCGAGAGAGATATAAATCAAGCTGAAAATCTACCATCCAATTCATTTGGTGTAAACTGGCCCTATGTGAATCTCCTAAATCGCATTCAAGACCAGTACACGTAA

SEQ ID NO: 48 - protein, 283 aa, Artificial Sequence
  Whispovirus wssv. >P5MICT165230 (VP39B)
MSSNGDEPAVTEAEIASVEAQLGAAHHDNSWITRKSDQLKYRLGAIAYSVAKNASIKYIEDQVRQEINSHLTNVMTFEHLYEDAFNPVICEAIFEKGIPVVMEKVYDVNRRIMEPREDFITEILKEERWRRYIPGFYHTSFSFKYNTIAFTDSSTSFSVPINDKHMLSITPPGAAQGDLIDLSLSFKIDSSAKTLTLEFNRKSTFAGIVNRPKSVVILSNLRNSDSSDNIGDYLKRNDPIYISHDTNGIINPSEDSASLITIHMPEIENASDDLYIDFNLFVF

SEQ ID NO: 49 - protein, 852 aa, Artificial Sequence
  Whispovirus wssv. >P5MICG165230 (VP39B)
ATGTCGTCTAACGGAGATGAGCCTGCTGTGACTGAAGCTGAAATCGCTTCAGTGGAGGCTCAATTGGGAGCTGCTCACCATGACAATTCTTGGATCACAAGAAAGAGTGACCAATTAAAGTATCGCTTAGGTGCAATTGCCTATTCGGTAGCAAAAAATGCCTCTATAAAATATATAGAGGATCAAGTAAGGCAAGAAATCAATAGCCATTTAACTAATGTAATGACTTTTGAACATCTTTACGAAGACGCTTTCAATCCTGTTATCTGTGAAGCAATTTTTGAGAAAGGAATACCAGTGGTTATGGAAAAAGTATACGATGTGAATAGACGGATCATGGAACCCAGGGAAGATTTCATAACTGAAATTTTAAAAGAGGAGCGGTGGAGAAGATATATACCTGGTTTTTATCATACATCATTTTCTTTCAAGTACAATACTATTGCCTTTACCGACTCTTCAACTTCATTTAGTGTACCAATAAACGATAAACACATGTTATCAATCACTCCCCCTGGAGCTGCTCAAGGGGATTTAATTGATTTAAGTTTATCGTTCAAAATAGATTCTTCAGCCAAAACTCTCACGTTAGAATTTAACCGCAAATCCACGTTCGCTGGTATTGTAAACAGACCAAAAAGTGTAGTGATATTATCAAATCTAAGAAATAGTGATTCTTCTGATAACATAGGTGATTATCTAAAGAGAAATGATCCTATATATATTAGTCATGATACAAATGGCATAATCAACCCATCCGAGGATTCGGCCTCTCTCATTACAATTCACATGCCTGAAATCGAAAACGCGAGTGATGATTTATACATAGATTTCAATCTGTTTGTTTTTTAG

SEQ ID NO: 50 - protein, 309 aa, Artificial Sequence
  Whispovirus wssv. >P5MICT165149 (VP38A)
MSSSSSETPKTSTDTGEERIKDIVNALDNNGEWLSSYIDPIINNHISRKTAETVQKINQEVDERYDRKIADKINEIKSSIFTSAQTMYDQYAIDTFQEGKGANGTGPVMGPVNTVIDTTLNKMRGNMLEYAEDMWDGDDWKRFSSSMTTLEFDLSYSDLTMMRGSDGYFAFPFRGTKKIKMDGSRKKEDPINCIISVTYPNKVGDEWEEGKEREVNFNLERVDDYERDIHVSILCMLHAQLDNFEQALGENANSFYFKKGQRVMFLPKKSKLFNRPTVEDSDMFSIIFPPASDQDFADDIYYRIIVTCS

SEQ ID NO: 51 - protein, 930 aa, Artificial Sequence
  Whispovirus wssv. >P5MICG165149 (VP38A)
ATGTCTTCTTCGTCTTCTGAAACTCCTAAGACTTCCACCGATACTGGGGAAGAAAGGATTAAAGACATTGTAAATGCTCTAGATAATAATGGCGAGTGGTTGTCTTCCTATATTGATCCGATTATCAATAATCACATCTCACGAAAAACGGCAGAAACTGTCCAAAAAATCAACCAAGAAGTTGATGAACGGTACGATAGAAAAATAGCCGACAAAATCAACGAAATAAAATCATCCATCTTTACAAGTGCTCAGACTATGTATGACCAATATGCAATAGACACATTTCAAGAAGGAAAAGGAGCCAACGGGACTGGACCAGTCATGGGGCCAGTGAACACGGTTATCGATACAACTTTAAATAAAATGAGGGGAAATATGCTCGAATACGCTGAAGATATGTGGGACGGAGATGACTGGAAACGATTTTCCAGTTCTATGACAACGCTTGAATTTGATCTAAGTTACTCTGATTTAACTATGATGCGTGGTTCTGACGGGTATTTTGCATTCCCTTTCCGTGGAACAAAAAAGATAAAGATGGACGGTTCAAGAAAGAAAGAAGACCCAATTAATTGTATCATTTCAGTAACATATCCAAACAAAGTAGGGGATGAGTGGGAAGAGGGTAAAGAACGTGAAGTGAATTTTAACCTAGAAAGAGTAGACGACTATGAAAGAGATATCCATGTTTCAATTTTGTGCATGTTACATGCACAACTTGATAATTTCGAACAAGCATTAGGAGAAAATGCAAACTCTTTTTATTTTAAAAAGGGGCAAAGAGTCATGTTCTTACCCAAGAAATCTAAACTGTTCAATAGACCTACTGTAGAAGATTCTGATATGTTTTCTATAATATTCCCACCTGCATCTGACCAAGATTTTGCAGATGATATTTATTATCGAATAATTGTAACATGTTCATAA

SEQ ID NO: 52 - protein, 321 aa, Artificial Sequence
  Whispovirus wssv. >P5MICT165281 (VP38B)
MCTLKTYKMTTSTEISKNLSDVLSIKATGDWCSNIKTVFSPFTEGKGNLPNSLPFTRSPNTTCGSREAANATEHFITVFAKDKYERKRVKRTIGFTLDNTKELTPNRYLVADVYSWQEEKMVFEGFCVPPGKSGTFVRYSNEDKSFLLADTGRYMKKKYDDPENKTSSGGDDDDDDDDDDDDNNNVDVYEENDPRNVFEVEKDEKYACTFSILVYRAMKKSPPVCRGLLVETDGPSSHPKRAPSAFNPFGGSSMLNGYGAGADALEEEDEVDGVPERERITNFALKRGPATGQNFVSVKLEHDGSKADLYNVTCFSKQRGV

SEQ ID NO: 53 - protein, 966 aa, Artificial Sequence
  Whispovirus wssv. >P5MICG165281 (VP38B)
ATGTGCACATTAAAAACATACAAAATGACTACTTCAACAGAAATATCAAAGAACCTTTCAGATGTGTTATCCATCAAGGCAACTGGAGATTGGTGCAGTAATATCAAGACGGTATTTTCACCCTTCACAGAAGGCAAGGGAAATTTACCAAACAGTCTCCCGTTTACGAGAAGTCCCAATACAACATGTGGTTCAAGAGAGGCGGCAAACGCCACAGAGCATTTTATCACCGTCTTTGCAAAGGACAAATATGAGCGGAAAAGAGTAAAACGTACAATCGGATTCACCCTCGACAACACAAAGGAGTTGACGCCCAACAGATACTTGGTAGCAGATGTATACTCTTGGCAAGAAGAGAAAATGGTGTTTGAAGGATTTTGTGTCCCACCAGGAAAGTCGGGAACATTTGTACGCTACTCTAATGAAGATAAAAGTTTTCTACTAGCAGATACCGGAAGATATATGAAAAAGAAGTACGATGATCCAGAAAATAAGACCAGTAGTGGGGGTGATGATGACGATGACGACGATGATGATGATGACGACAACAACAATGTTGACGTGTATGAAGAAAACGACCCCAGAAATGTATTCGAGGTCGAAAAGGATGAAAAATATGCCTGTACTTTTTCAATTTTGGTCTATAGAGCAATGAAAAAGTCTCCTCCTGTATGTAGAGGGTTATTAGTAGAGACAGATGGACCCTCATCTCACCCTAAACGGGCCCCGTCAGCATTTAATCCATTCGGAGGAAGTTCTATGTTGAACGGTTATGGTGCAGGTGCAGATGCACTAGAAGAAGAGGATGAAGTTGATGGAGTTCCTGAAAGAGAGAGGATTACAAATTTTGCTCTCAAGAGAGGACCTGCAACTGGCCAGAACTTTGTATCTGTTAAACTGGAACATGATGGATCTAAAGCAGACCTGTACAACGTCACGTGCTTCTCCAAGCAGCGTGGAGTATAA

SEQ ID NO: 54 - protein, 297 aa, Artificial Sequence
  Whispovirus wssv. >P5MICT164967 (VP36A)
MALQEKDITIGNVSAALRELMYSPTHMQHHDKLNTFLDRNVESSSEEKIRQIVDKIRSQTTSDISETVNNVTTNGTAFSLFEDTLEGMVKKNIGDNLQSGDFIDGRKKLNDMKSLATGAILSRQRDFVAESITGTKDWLKAIMGCGIIRYTVFVNNLARSTLDNDDDKAATYYNTPIYGGYCKMAIKDYEIPDSYSKVEAEHTVEGRKMTFNIKWRGDTINNLITIIPSVTGYLASISEDADVQAPLLLNCNNCFIEADMSSLYMDEKKTEASFTLNLPEIEGADANAVYEICIVVV

SEQ ID NO: 55 - protein, 894 aa, Artificial Sequence
  Whispovirus wssv. >P5MICG164967 (VP36A)
ATGGCATTACAGGAAAAGGATATAACTATAGGGAATGTTTCTGCTGCCCTACGAGAGTTGATGTACTCACCCACACATATGCAGCATCACGATAAGCTAAACACATTCCTGGACAGAAATGTTGAATCATCTTCAGAAGAGAAAATAAGACAAATTGTGGATAAAATACGATCCCAAACAACATCTGACATATCTGAAACAGTCAATAATGTCACAACTAATGGGACTGCATTTTCCCTTTTCGAAGATACCTTAGAAGGTATGGTGAAAAAAAATATAGGTGATAACCTTCAGAGTGGGGACTTTATTGATGGCCGTAAAAAGCTCAATGACATGAAGAGTCTAGCTACTGGAGCCATCTTATCTAGACAGCGAGATTTTGTTGCAGAAAGTATAACAGGAACAAAGGACTGGCTCAAGGCTATAATGGGTTGTGGTATTATAAGGTATACTGTATTTGTCAATAACCTTGCAAGATCAACACTCGATAATGATGATGACAAGGCAGCAACCTATTATAACACCCCTATATATGGCGGGTATTGTAAAATGGCTATAAAGGACTATGAAATACCAGATTCGTACAGCAAGGTCGAAGCGGAACATACAGTTGAAGGAAGAAAGATGACCTTTAATATAAAATGGAGAGGCGATACCATAAACAACCTAATAACAATCATCCCTTCAGTGACAGGTTATCTTGCTTCCATCTCTGAAGACGCAGATGTGCAGGCGCCATTACTTTTAAACTGCAACAACTGTTTTATAGAGGCAGATATGAGTAGCCTCTACATGGATGAGAAAAAAACAGAGGCATCATTTACCCTCAACTTACCGGAAATCGAAGGAGCTGATGCGAATGCAGTCTATGAAATATGTATAGTAGTAGTTTGA

SEQ ID NO: 56 - protein, 501 aa, Artificial Sequence
  Whispovirus wssv. >P5MICT165142
MVYKGFVSPSFITIRTMTSNRPTTSPLSFSEGFSLSGDKYDTYEDILLEQFNCFKTSSPSSARKSEIEDKTLIFQLKEGEKFHLAKGIEELREILDDNSATIEPIISPTTFNDRNELLNHEGDISSSPLYTQIMKHISPEHDIYELDLIVGTDLLFGLGVNLRNVSKLMKKISYGTLNVVDVCHRKFFNNRIIVNPISSSFSKNVCIIPLFSAAEEFSSLGECRDLFNGICDDVERYINSYFFYPENTTTTTTTAPSSPEMEIADEEEQSPKTIKRNDNASRNWSGVCLIFEVFKNTYYIINRGDRGGSFEKAVKSAISSIKEKRCKITDINGNKPRLVMVITGCYTELYFKDALKQIGENRRKFLKMNGNYFSLIDEQADLIEFAMSVSGAGERIFVNGLGMFQNRKMIPVIDPLTYENVVCGEHDIQKEDAILSVRRAIADYNDFVSKNKRGKKRSAEEENEDEDADASSSSSSSPPPSSPPAHKKSRLPDEGEKCTLC

SEQ ID NO: 57 - protein, 1506 aa, Artificial Sequence
  Whispovirus wssv. >P5MICG165142 sequence_region_id=4491 start=140111 stop=141616 length=1506
ATGGTATATAAAGGCTTTGTATCTCCATCATTTATCACTATTCGTACGATGACGTCCAACAGACCAACAACATCCCCTCTTTCGTTCTCTGAAGGCTTCTCGCTTTCAGGGGATAAGTATGATACGTATGAGGATATCTTACTTGAACAATTCAACTGTTTCAAGACATCTTCTCCTTCTTCTGCTCGTAAAAGTGAAATAGAGGATAAAACTTTAATCTTTCAACTTAAAGAAGGAGAAAAATTCCATCTTGCAAAGGGCATAGAAGAGCTCCGTGAGATTCTAGACGATAATTCTGCAACAATTGAACCTATTATTTCTCCAACGACATTCAATGACAGAAACGAATTACTAAACCACGAGGGAGATATATCCTCAAGTCCCCTATATACTCAGATAATGAAGCATATTTCACCAGAGCATGATATTTATGAATTGGACCTTATTGTTGGCACTGATTTGCTTTTTGGTCTAGGTGTGAATCTACGCAACGTTTCTAAACTGATGAAGAAAATATCGTATGGTACTTTAAATGTAGTTGATGTGTGCCACAGAAAATTTTTCAACAATAGGATTATAGTTAATCCCATTTCTTCGTCATTCTCAAAAAATGTGTGTATTATTCCTCTATTTTCTGCAGCTGAAGAATTTTCGTCTCTGGGGGAATGCAGGGATTTATTCAACGGTATTTGTGATGACGTAGAGAGATATATCAACTCTTATTTTTTCTACCCTGAAAATACTACTACTACTACTACTACTGCTCCTTCGTCGCCCGAAATGGAAATTGCAGATGAGGAAGAACAATCCCCAAAAACTATAAAGAGAAATGACAACGCAAGTAGAAACTGGTCTGGTGTCTGTTTGATTTTTGAAGTATTTAAAAACACGTACTACATTATTAATAGAGGAGATAGAGGAGGTTCTTTTGAAAAGGCTGTGAAGAGTGCAATTTCTTCTATCAAGGAAAAGAGATGTAAAATCACAGATATTAATGGTAATAAACCTCGATTGGTTATGGTGATAACTGGGTGTTATACAGAATTGTACTTCAAAGATGCACTTAAACAGATTGGAGAAAACAGGCGCAAATTTTTGAAAATGAATGGGAATTACTTTTCTCTGATTGATGAACAAGCAGATCTAATCGAATTCGCGATGAGTGTTTCTGGTGCCGGGGAGAGGATTTTTGTTAACGGTTTGGGGATGTTCCAGAACCGTAAAATGATACCTGTAATTGATCCTCTCACATATGAAAATGTTGTATGTGGTGAGCATGATATACAAAAAGAAGATGCTATTCTTTCTGTAAGGAGAGCTATTGCAGACTATAATGACTTTGTAAGTAAGAACAAGAGAGGGAAGAAACGCAGCGCAGAAGAAGAAAATGAAGATGAAGATGCAGACGCTAGCAGCAGCAGCAGCAGCAGTCCTCCTCCTTCTTCTCCTCCTGCACATAAAAAATCACGTCTTCCGGATGAAGGCGAAAAATGTACACTCTGTTAA

SEQ ID NO: 58 - protein, 281 aa, Artificial Sequence
  Whispovirus wssv. >P5MICT165144 (VP36B)
MAVNLDNVLVNINNKDEDLTKLVSEAIKRRAKTVFDTKNQAGFDMRRQVEAALYEAISKKKEKAIKAFDELIQERGDEITPLTTMQYEEWVNRTITPSLTTENLLGDVEHADFLLDRMTPVSEEDIEGFAASTFKEVSDSKTATVIVKADCETGDIDEVYNLAPSFGVTQEIKIYRSNNSSELDNVADSFHIYKISATDSDSGNTKKLLYGLRNKKAGYTCLCRIFAEIESDGIMANTNIGVAENNRDEIDENEEGKYGFLIPKQPAGAKLIIYFFLNCWT

SEQ ID NO: 59 - protein, 846 aa, Artificial Sequence
  Whispovirus wssv. >P5MICG165144 (VP36B)
ATGGCGGTAAACTTGGATAATGTTCTTGTGAATATCAACAACAAGGATGAAGATCTTACAAAACTCGTATCCGAGGCAATAAAGCGGCGAGCTAAAACTGTATTTGACACTAAAAATCAAGCAGGGTTTGACATGAGACGTCAAGTTGAAGCTGCATTATATGAAGCAATATCCAAAAAGAAAGAAAAGGCCATAAAGGCATTCGATGAGCTCATACAAGAAAGAGGTGATGAAATTACACCTTTGACTACAATGCAGTATGAAGAGTGGGTAAACCGTACAATAACTCCCTCATTGACGACTGAAAATTTATTAGGTGATGTTGAGCACGCCGATTTTTTACTGGACCGAATGACACCCGTAAGCGAGGAAGATATTGAAGGTTTCGCTGCTTCTACTTTTAAGGAGGTATCAGATTCAAAAACTGCAACAGTCATAGTTAAGGCAGATTGTGAAACGGGGGATATCGATGAAGTGTATAATCTTGCACCATCATTCGGCGTCACTCAAGAAATTAAAATATATAGGTCAAACAATTCCTCGGAATTGGATAATGTCGCAGATTCTTTCCATATTTATAAAATTTCTGCAACAGATAGCGACAGTGGCAATACTAAAAAATTGTTGTATGGGTTAAGGAATAAAAAAGCAGGTTATACGTGTTTGTGTAGAATTTTTGCAGAAATTGAATCAGATGGGATTATGGCCAATACAAATATCGGTGTCGCTGAAAACAACAGAGATGAAATTGATGAAAACGAAGAAGGTAAATATGGTTTTTTAATACCCAAACAACCAGCTGGTGCAAAATTGATCATCTACTTCTTTTTAAATTGTTGGACATAA

SEQ ID NO: 60 - protein, 466 aa, Artificial Sequence
  Whispovirus wssv. >P5MICT165199 (VP51C)
MSASLILDEYLKKTASAVLDVADSFEKIKGEIQSPEEAAALSVALYGAPPKPSASAVASIITGERTSLNDKYLSDNVLLKMSVARVGQENNRKRADQAADEIRTIMEDITGSLSGAYRQYSPLEEENKVHIGIMNNKTPSIVCGYYTMDTSISSEPLSLTDFQNPTVIANVTKRMESIFSKVDSARSTRFDAFVNGVANNMDIKSSIDWANMVENVIKLPDSTPNPCSVDTIVSRDASVVKTAVNDIYASVGKSYCRPATQLTFMSEIEKLRKAAVVCFEALMSDTRERAFVEFLFYVSFKEDASNTNSKLFVQNKLSSMSGNPRQPIKLVRRSAEETLFGLCFMFKVMPPEFMNCIFNFPTIPHSTQYHGLYGTCLTPLLRKYGSSFEKSWAHFEEILSERANAVKKFGVNDTRIDCLDAVANLTGPVYVLILDLVRTLSAQRSCSTKFLREIKENYLLWNRFVS

SEQ ID NO: 61 - protein, 1401 aa, Artificial Sequence
  Whispovirus wssv. >P5MICG165199 (VP51C)
ATGTCTGCATCTTTAATATTGGACGAATACCTCAAGAAGACTGCTTCAGCCGTTCTGGATGTAGCTGACTCATTTGAGAAAATCAAGGGAGAAATCCAATCACCTGAGGAGGCTGCGGCTCTTTCTGTTGCTCTCTATGGAGCACCTCCAAAACCTTCAGCTTCGGCTGTGGCCTCTATCATCACTGGAGAAAGAACATCTTTAAACGACAAATATCTATCGGATAATGTCCTATTGAAAATGTCTGTTGCTCGCGTTGGACAAGAAAATAATCGCAAGAGAGCCGACCAGGCAGCTGATGAAATTAGAACCATCATGGAAGATATTACAGGGAGTTTGTCCGGTGCGTACAGGCAATATAGCCCGCTCGAGGAAGAAAATAAGGTGCATATAGGCATCATGAATAACAAAACGCCTAGCATTGTTTGTGGATATTATACAATGGACACATCTATTTCTTCCGAACCTCTTTCTCTAACAGATTTTCAAAACCCCACTGTCATTGCCAATGTGACTAAGCGGATGGAGAGCATTTTTTCAAAGGTCGACTCTGCTAGGTCTACAAGATTCGACGCTTTTGTTAATGGTGTTGCGAATAATATGGATATAAAGTCATCAATAGATTGGGCAAATATGGTAGAAAATGTGATCAAATTACCAGATTCTACACCTAACCCTTGTTCAGTTGACACTATTGTGTCCAGAGACGCAAGTGTAGTTAAAACAGCAGTTAATGATATATACGCTTCTGTTGGAAAATCTTATTGTCGTCCTGCAACACAGCTAACCTTTATGAGCGAGATTGAAAAACTGCGAAAGGCTGCAGTTGTATGTTTTGAGGCACTCATGTCCGATACTAGGGAGAGGGCATTCGTAGAGTTCCTATTTTACGTTAGCTTTAAGGAAGATGCATCAAATACCAATTCAAAATTGTTTGTTCAGAATAAGCTATCTTCCATGTCTGGAAACCCCAGACAGCCCATAAAATTGGTACGCCGTTCTGCTGAGGAAACACTATTCGGGCTCTGTTTCATGTTTAAGGTAATGCCTCCAGAATTCATGAACTGTATATTTAACTTCCCTACCATTCCCCATTCAACACAATACCATGGTCTATATGGTACATGTTTAACCCCTCTACTTAGAAAATACGGTTCTTCATTCGAAAAGTCCTGGGCTCATTTTGAGGAAATTTTAAGCGAAAGAGCCAATGCAGTGAAAAAATTTGGTGTAAACGATACGAGGATAGATTGTCTAGATGCAGTAGCAAATCTCACCGGACCTGTGTATGTTCTCATTTTAGATCTTGTACGTACTCTAAGTGCGCAGAGATCGTGTTCAACTAAATTTCTCCGTGAAATTAAGGAAAACTATCTTTTGTGGAATAGGTTTGTGTCATAA

SEQ ID NO: 62 - protein, 204 aa, Artificial Sequence
  Whispovirus wssv. >P5MICT165202 (VP26)
MEFGNLTNLDVAIIAILSIAIIALIVIMVIMIVFNTRVGRSVVANYDQMMRVPIQRRAKVMSIRGERSYNTPLGKVAMKNGLSDKDMKDVSADLVISTVTAPRTDPAGTGAENSNMTLKILNNTGVDLLINDITVRPTVIAGNIKGNTMSNTYFSSKDIKSSSSKITLIDVCSKFEDGAAFEATMNIGFTSKNVIDIKDEIKKK

SEQ ID NO: 63 - protein, 615 aa, Artificial Sequence
  Whispovirus wssv. >P5MICG165202 (VP26)
ATGGAATTTGGCAACCTAACAAACCTGGACGTTGCAATTATTGCAATCTTGTCCATTGCAATCATTGCTCTAATCGTTATCATGGTTATAATGATTGTATTCAACACACGTGTTGGAAGAAGCGTCGTCGCTAATTATGATCAGATGATGCGAGTCCCAATTCAAAGAAGGGCAAAGGTAATGTCAATTCGTGGAGAGAGGTCCTACAATACTCCTCTTGGAAAGGTGGCCATGAAGAATGGTCTCTCCGATAAGGACATGAAGGATGTTTCTGCTGATCTTGTCATCTCTACCGTCACAGCCCCAAGGACTGATCCCGCTGGCACTGGGGCCGAGAACTCTAACATGACTTTGAAGATCCTCAACAACACTGGCGTCGATCTCTTGATCAACGACATTACTGTTCGGCCAACTGTTATTGCAGGAAACATTAAGGGAAATACTATGTCGAACACTTACTTCTCGAGCAAGGACATTAAATCTTCATCTTCAAAAATTACCCTCATTGACGTGTGCAGCAAATTTGAAGACGGCGCAGCCTTCGAAGCTACAATGAACATTGGATTCACCTCCAAGAATGTGATCGATATCAAGGACGAAATCAAGAAGAAGTAA

SEQ ID NO: 64 - protein, 261 aa, Artificial Sequence
  Whispovirus wssv. >P5MICT165231 (VP31)
MSNGATISDERLILILDKIVERRGVSNLSELLIHPITKHINELLKNTVRHGDRVYMKDAELDVRSRLEDIKKDCVLKAIEKQGIDVRQIITDYLAKRKLTQNLVHWYRPPISCTDIDEKIQQETGQVGRCSVATYNLRIGGDDGEFTRYDFSIPLGDFKITAKLFRSINDEDVDAVILVSRSDVVNDVLSFEAFNRTGERVVIFFNVIVEGKSKDIDIVCKSRYKHTHILNGESATYAVKRIKRGDTRDDILFAITAFKEE

SEQ ID NO: 65 - protein, 786 aa, Artificial Sequence
  Whispovirus wssv. >P5MICG165231 (VP31)
ATGTCTAATGGCGCAACTATAAGCGATGAGAGGTTGATCCTCATCCTTGATAAAATTGTAGAAAGACGTGGTGTTTCTAATCTATCTGAATTGTTGATACACCCCATAACCAAACACATAAACGAATTGTTGAAGAACACTGTAAGACATGGAGACAGAGTTTACATGAAGGATGCAGAACTGGATGTGAGATCTCGCCTAGAAGACATAAAAAAGGATTGTGTTTTAAAGGCAATTGAAAAACAAGGAATAGATGTTAGACAAATAATAACTGATTACTTGGCTAAACGAAAACTAACGCAAAATCTTGTACATTGGTATCGGCCCCCAATATCTTGCACAGATATAGACGAAAAAATTCAACAAGAAACTGGTCAAGTAGGGCGGTGTAGTGTTGCTACGTACAATTTGAGAATTGGTGGTGACGATGGAGAATTTACAAGGTACGATTTCTCCATTCCCTTGGGAGATTTTAAAATAACGGCAAAATTGTTTCGTTCCATAAATGATGAGGATGTAGATGCAGTGATTCTTGTGTCTCGTAGTGACGTAGTTAATGACGTGCTAAGCTTTGAAGCATTTAATCGAACAGGAGAACGCGTAGTCATATTCTTTAATGTGATTGTTGAAGGGAAGAGTAAAGATATTGATATTGTATGTAAATCTAGATATAAACACACCCATATACTAAACGGAGAATCTGCAACATACGCTGTTAAACGTATAAAAAGAGGCGATACAAGGGACGATATATTGTTTGCAATCACTGCTTTTAAGGAGGAGTAA

SEQ ID NO: 66 - protein, 68 aa, Artificial Sequence
  Whispovirus wssv. >P5MICT165277 (VP12B)
MSDMTRNIIVGLAVVVIALSMVAFMLSVTPALTGFLLGLGVSALGVTLFGCPTMKSPGGGNATINPVA

SEQ ID NO: 67 - protein, 207 aa, Artificial Sequence
  Whispovirus wssv. >P5MICG165277 (VP12B)
ATGTCTGATATGACCAGAAACATCATCGTCGGCTTGGCCGTTGTCGTCATCGCATTGAGCATGGTCGCTTTCATGCTTTCTGTTACTCCTGCACTTACCGGATTCCTCCTAGGTTTGGGTGTATCAGCACTAGGAGTTACACTCTTTGGATGTCCCACTATGAAATCTCCAGGGGGAGGAAATGCTACAATCAACCCCGTGGCATAA

SEQ ID NO: 68 - protein, 121 aa, Artificial Sequence
  Whispovirus wssv. >P5MICT165305 (VP19)
MATTTNTLPFGRTGAQAAGPSYTMEDLEGSMSMARMGLFLIVAISIGILVLAVMNVWMGPKKDSDPDTDKDTDDDDDTANDNDDEDKYKNRTRDMMLLAGSALLFLVSAATVFMSYPKRRQ

SEQ ID NO: 69 - protein, 366 aa, Artificial Sequence
  Whispovirus wssv. >P5MICG165305 (VP19)
ATGGCCACCACGACTAACACTCTTCCTTTCGGCAGGACCGGAGCCCAGGCCGCTGGCCCTTCTTACACCATGGAAGATCTTGAAGGCTCCATGTCTATGGCTCGCATGGGTCTCTTTTTGATCGTTGCTATCTCAATTGGTATCCTCGTCCTGGCCGTCATGAATGTATGGATGGGACCAAAGAAGGACAGCGATCCTGACACTGATAAGGACACCGATGATGATGACGACACTGCCAACGATAACGATGATGAGGACAAATATAAGAACAGGACCAGGGATATGATGCTTCTGGCTGGGTCCGCTCTTCTGTTCCTCGTTTCCGCCGCCACCGTTTTTATGTCTTACCCCAAGAGGAGGCAGTAA

SEQ ID NO: 70 - protein, 204 aa, Artificial Sequence
  Whispovirus wssv. >P5MICT165312 (VP28)
MDLSFTLSVVSAILAITAVIAVFIVIFRYHNTVTKTIETHTDNIETNMDENLRIPVTAEVGSGYFKMTDVSFDSDTLGKIKIRNGKSDAQMKEEDADLVITPVEGRALEVTVGQNLTFEGTFKVWNNTSRKINITGMQMVPKINPSKAFVGSSNTSSFTPVSIDEDEVGTFVCGTTFGAPIAATAGGNLFDMYVHVTYSGTETE

SEQ ID NO: 71 - protein, 615 aa, Artificial Sequence
  Whispovirus wssv. >P5MICG165312 (VP28)
ATGGATCTTTCTTTCACTCTTTCGGTCGTGTCGGCCATCCTCGCCATCACTGCTGTGATTGCTGTATTTATTGTGATTTTTAGGTATCACAACACTGTGACCAAGACCATCGAAACCCACACAGACAATATCGAGACAAACATGGATGAAAACCTCCGCATTCCTGTGACTGCTGAGGTTGGATCAGGCTACTTCAAGATGACTGATGTGTCCTTTGACAGCGACACCTTGGGCAAAATCAAGATCCGCAATGGAAAGTCTGATGCACAGATGAAGGAAGAAGATGCGGATCTTGTCATCACTCCCGTGGAGGGCCGAGCACTCGAAGTGACTGTGGGGCAGAATCTCACCTTTGAGGGAACATTCAAGGTGTGGAACAACACATCAAGAAAGATCAACATCACTGGTATGCAGATGGTGCCAAAGATTAACCCATCAAAGGCCTTTGTCGGTAGCTCCAACACCTCCTCCTTCACCCCCGTCTCTATTGATGAGGATGAAGTTGGCACCTTTGTGTGTGGTACCACCTTTGGCGCACCAATTGCAGCTACCGCCGGTGGAAATCTTTTCGACATGTACGTGCACGTCACCTACTCTGGCACTGAGACCGAGTAA

SEQ ID NO: 72 - protein, 80 aa, Artificial Sequence
  Whispovirus wssv. >P5MICT165104 (VP15)
MTKYPENKRLLSRNKETLKMVARSSKTKSRRGSKKRSTTAGRISKRRSPSMKKRAGKKSSTVRRRSSKSGKKSGARKSRR

SEQ ID NO: 73 - protein, 243 aa, Artificial Sequence
  Whispovirus wssv. >P5MICG165104 (VP15)
ATGACAAAATACCCCGAGAACAAAAGATTGTTGTCTAGGAACAAAGAAACATTAAAAATGGTTGCCCGAAGCTCCAAGACCAAATCCCGCCGTGGAAGCAAGAAGAGGTCCACCACTGCTGGACGCATCTCCAAGCGGAGGAGCCCATCAATGAAGAAGCGTGCAGGAAAGAAGAGCTCCACTGTCCGTCGCCGTTCCTCAAAGAGCGGAAAGAAGTCTGGAGCCCGCAAGTCAAGGCGTTAA

SEQ ID NO: 74 - protein, 100 aa, Artificial Sequence
  Whispovirus wssv. >P5MICT165174 (VP13A)
METTTLAFIAMGLLFVVLMVYIFIQYTSSNKNKTEERKGSKLSSSSTSSTSGPTFKREASPELREDIPLSPRSSGPELNLTDAEFIDPELFSEARVSPDR

SEQ ID NO: 75 - protein, 303 aa, Artificial Sequence
  Whispovirus wssv. >P5MICG165174 (VP13A)
ATGGAAACTACTACGCTCGCTTTCATTGCAATGGGTTTGCTTTTCGTGGTGTTGATGGTGTACATCTTTATACAGTACACGTCATCAAATAAAAACAAGACAGAGGAAAGAAAGGGTAGTAAATTATCATCATCATCAACTTCTTCTACTTCTGGTCCAACATTTAAGAGAGAAGCGTCTCCTGAATTAAGAGAAGACATACCACTTTCTCCACGATCTTCTGGTCCAGAACTGAATCTAACTGACGCTGAATTTATAGACCCTGAACTCTTTTCTGAAGCCAGGGTCAGTCCCGACCGTTAA

SEQ ID NO: 76 - protein, 117 aa, Artificial Sequence
  Whispovirus wssv. >P5MICT165212 (VP13B)
MRFIPMLIIALIAAFVIAALLTANSNYLDHNINKELNLTRSLQLRGTFTPEDIAHNNRILPSKLSVLERGSIILAEMDKYKNAQPTVNNSQERRNISTPQQQQQTTPSSQSSSQVEL

SEQ ID NO: 77 - protein, 354 aa, Artificial Sequence
  Whispovirus wssv. >P5MICG165212 (VP13B)
ATGAGGTTTATCCCGATGTTGATAATTGCGCTTATCGCTGCATTTGTTATTGCAGCTCTTCTTACTGCCAATTCAAATTACCTGGATCACAATATCAATAAGGAACTAAATTTGACCCGTTCCCTTCAACTTCGGGGAACATTCACACCAGAAGATATAGCTCATAACAACAGAATTCTCCCTTCCAAGCTGAGTGTTTTAGAAAGAGGGTCAATCATTTTAGCAGAAATGGACAAGTACAAAAATGCACAACCTACAGTAAATAATTCTCAAGAGAGGAGGAACATTTCTACTCCTCAACAACAACAACAGACCACCCCCTCATCCCAATCATCTTCCCAAGTTGAACTTTAA

SEQ ID NO: 78 - protein, 95 aa, Artificial Sequence
  Whispovirus wssv. >P5MICT164899 (VP12A)
MDQLTENPSLLAERPVFRQKVIDLYREEILRDLIKKMTADMTSAIEEECTAAVADGSFWRDMRYEMVAHQHDVTFAAKNMEGYEEFAAEVRRVEG

SEQ ID NO: 79 - protein, 288 aa, Artificial Sequence
  Whispovirus wssv. >P5MICG164899 (VP12A)
ATGGACCAGCTTACAGAAAATCCTTCTCTTTTAGCAGAGAGGCCTGTCTTTAGGCAGAAGGTTATAGATTTGTATAGGGAGGAAATACTACGTGATCTTATTAAAAAAATGACAGCTGACATGACTTCTGCCATTGAAGAAGAATGCACGGCCGCTGTTGCGGATGGATCTTTTTGGCGAGATATGCGATATGAAATGGTAGCTCATCAACATGACGTGACCTTTGCAGCAAAGAATATGGAAGGGTATGAAGAATTCGCGGCAGAGGTCAGGCGTGTGGAGGGGTAA

SEQ ID NO: 80 - protein, 433 aa, Artificial Sequence
  Whispovirus wssv. >P5MICT165229 (VP11)
MALSNNGGIYIVFAVIVLVIGASIALFFAISGVGKGTLHSNAKTKKSKKYKLDSKYTDDDEKTDDDNNNNGGGGGGTVDVINETALQRQTREHFARTLEKAEDEFFTKLADQEFDTYKSENVWLIKDKITDGKVSIPEGDINVPDVGQAIADENLFDLIGTNHDEVKETMDEVVAQKSTNITYEQLVIDLTNILLFGTVTVDPSDENGDESLQRSTDPDAEMVMLTTTPSSQLARQQQPPQPTPDYLARYSKELVINNIRGGFISDRDMRTWQGRMSVHVNMKQRTFNVISAATNLDSLQVGLEPVLQKQGRAAVGGRIEKARIEFSFVVEGNRVRVYATNKTEDCFCSLLPNCYNVKKASDYWISSASTAKEKTYLFIANKNDETSFFYNFEEGVEEIDLDIFMTIDCAPNLPFIKNLPRPITDNNIMVALS

SEQ ID NO: 81 - protein, 1302 aa, Artificial Sequence
  Whispovirus wssv. >P5MICG165229 (VP11)
ATGGCACTTTCAAACAATGGAGGAATATACATTGTTTTTGCGGTTATTGTTTTGGTAATAGGAGCTTCTATTGCCCTCTTCTTTGCTATCTCGGGCGTAGGGAAGGGAACTCTACATTCAAATGCCAAAACAAAAAAGAGTAAGAAATATAAATTAGACTCTAAATACACTGACGATGATGAAAAAACTGACGACGATAATAATAATAATGGAGGAGGAGGGGGAGGAACAGTTGATGTTATCAATGAGACAGCGCTTCAACGTCAAACGAGAGAGCATTTTGCAAGAACTCTTGAAAAAGCTGAGGATGAATTCTTCACCAAATTAGCAGATCAGGAATTTGACACATACAAATCAGAAAACGTATGGTTAATAAAGGATAAAATAACAGATGGAAAAGTTTCAATCCCTGAAGGTGACATAAACGTCCCCGATGTCGGACAGGCAATTGCTGATGAAAACTTGTTCGATCTCATAGGGACGAACCATGACGAAGTCAAGGAAACGATGGATGAAGTTGTTGCACAAAAATCTACCAATATCACTTACGAACAACTCGTAATAGACTTGACCAATATTTTATTGTTTGGTACAGTAACAGTTGATCCTTCTGATGAAAATGGGGATGAAAGCCTACAGAGATCAACAGACCCAGACGCAGAAATGGTGATGTTGACAACAACACCTTCTTCACAACTAGCTAGACAACAACAACCTCCTCAACCTACACCTGATTACCTTGCCCGGTACTCAAAGGAATTGGTGATAAATAATATACGAGGAGGTTTTATCAGTGATCGTGATATGCGCACTTGGCAAGGACGAATGTCTGTACATGTCAACATGAAACAGAGGACATTTAATGTTATTAGTGCAGCAACGAATCTGGATTCTCTACAAGTTGGATTAGAACCCGTGCTACAAAAACAAGGTAGAGCAGCTGTGGGAGGACGTATTGAAAAAGCCCGGATAGAGTTTTCATTTGTAGTAGAAGGTAACCGTGTACGGGTATACGCTACAAACAAAACAGAGGACTGTTTTTGTAGTTTACTCCCCAACTGTTATAATGTTAAAAAGGCATCAGACTATTGGATAAGCTCTGCAAGCACAGCTAAGGAAAAAACGTACTTGTTTATTGCTAATAAAAATGATGAAACAAGTTTCTTCTATAACTTTGAGGAAGGTGTTGAAGAAATTGACCTGGACATTTTTATGACAATAGATTGTGCACCTAATCTTCCTTTCATTAAAAATTTACCAAGACCTATTACAGATAATAATATAATGGTTGCACTGTCATAA

SEQ ID NO: 82 - protein, 509 aa, Artificial Sequence
  Whispovirus wssv. >P5MICT165370
MASGFAIKGIVKNYRRIPSIIESIKSIRRSELAEGVYIVSLHKNTPKHEVDEIVNKIRLSAGNPCLEKTSLFLQHHSQMRNFYTRKGAESESDWLKRLPEDLRNINNIVKREALPHDKSFTFSPLYRILTDRLFNAAIHNCKYIIVTADLLMGCGITNNKVEKKLLSMGSILGGESMVPLHDIAHRLSYKGLRIENPIVGSCHDQCLVVPVSMLGKIFSSNMYPTFKNFDQCMALFLNAVVTHSAEKMDGKHERNKVIHMPNEVYLDAARRKYLEEKLEETNKLDAIDEEAREEYGNEIGRIGDKSTCLVFALSARDFFLTNRFNEDTPLYSGTERGIRFMCSNYCTMRDEGGFRPRLIMSAYGPTSYPIIFNTLYDQFNVQYYPCVSGVVLSFIGDDQLAPEPESLVDIVVRSIKNPSIRIFSGDGETVYQDGRRVDVGGEGKNQKFNREERTILNVLRIIKAYNEERTKEDEDEEEEEEEEEEQQTAATVTVESDWDLSLERGENWV

SEQ ID NO: 83 - protein, 1530 aa, Artificial Sequence
  Whispovirus wssv. >P5MICG165370 sequence_region_id=4491 start=276737 stop=275208 length=1530
ATGGCGTCCGGGTTTGCTATCAAGGGAATCGTTAAAAACTATAGAAGAATACCGTCCATTATCGAGTCTATCAAAAGTATACGGAGAAGCGAACTCGCTGAAGGTGTATATATCGTCTCTTTGCATAAAAATACTCCAAAACATGAGGTGGATGAAATTGTGAATAAAATACGCCTCTCAGCAGGCAACCCCTGCTTGGAAAAAACGTCATTATTTCTTCAACATCATTCACAAATGAGGAATTTCTATACAAGGAAAGGTGCTGAATCTGAATCTGATTGGCTCAAAAGACTACCAGAAGATTTGAGGAATATCAACAATATAGTGAAAAGAGAAGCTTTACCCCATGACAAGTCTTTCACTTTCTCCCCTCTATATAGAATTCTCACTGATAGACTATTCAATGCAGCAATTCACAACTGCAAGTACATAATTGTAACTGCTGATTTATTGATGGGTTGTGGGATAACCAACAACAAAGTCGAAAAGAAACTGTTAAGTATGGGTAGTATTTTAGGGGGCGAATCAATGGTACCTTTACACGATATAGCACATCGATTATCCTACAAAGGCCTCCGCATAGAAAATCCTATAGTGGGTAGTTGTCATGACCAATGCTTAGTTGTTCCAGTGAGTATGTTAGGGAAGATTTTTTCAAGTAATATGTACCCCACATTTAAAAATTTTGATCAATGCATGGCATTATTTTTGAATGCAGTTGTTACACATTCGGCCGAAAAAATGGACGGTAAGCATGAACGTAATAAGGTCATCCATATGCCAAACGAGGTATACCTTGACGCCGCAAGGAGGAAATACCTAGAAGAAAAACTAGAGGAAACCAACAAATTGGATGCTATCGATGAAGAAGCAAGGGAAGAATATGGAAACGAAATAGGAAGAATAGGAGACAAAAGTACGTGTCTCGTGTTTGCATTATCTGCACGAGACTTTTTCCTCACAAACAGATTCAATGAAGACACACCCCTATATTCTGGTACAGAAAGAGGAATCAGATTCATGTGTTCAAATTATTGTACAATGAGAGATGAGGGTGGTTTCAGGCCCCGTTTGATCATGTCTGCCTACGGGCCAACATCTTACCCTATCATCTTCAATACTTTATATGATCAATTCAATGTGCAATATTATCCATGTGTTTCTGGAGTTGTTTTATCTTTTATTGGCGATGATCAGTTAGCACCAGAACCAGAATCATTAGTGGACATTGTTGTACGTTCTATAAAAAATCCGTCTATTAGAATTTTTTCTGGTGATGGTGAAACAGTATACCAGGATGGACGTAGGGTCGATGTTGGTGGTGAGGGAAAGAATCAGAAGTTTAACCGAGAAGAGCGCACCATTTTAAATGTATTGAGGATAATTAAAGCATATAATGAAGAACGAACTAAAGAAGATGAAGATGAAGAGGAAGAAGAGGAGGAAGAAGAGGAACAACAAACAGCAGCAACAGTGACAGTAGAAAGTGATTGGGATCTCTCACTAGAGAGGGGGGAGAATTGGGTGTAG

SEQ ID NO: 84 - protein, 228 aa, Artificial Sequence
  Whispovirus wssv. >P5MICT165384 (VP35)
MVSSRTSTTSSSAVAATSTLLPTKRKREPEEVKVKVEVKMEQEELVEDSSSNKRPRIKEEKEEEHKETHHLSLPCKEEEDDGEEEEYEEEEDEEEYEDRVDDDTAEKMENLLVQLDNTTKNIKLKNPLREHDMAVSHYEHEFEVQNTVNFSFGVLSDIGFLINREAVSRWGNTPPPKEFGDMEIGSLTVNQLLHKCDNFVQAVVQKVKEDITPSIEVTIDSLIDDPCW

SEQ ID NO: 85 - protein, 687 aa, Artificial Sequence
  Whispovirus wssv. >P5MICG165384 (VP35)
ATGGTCTCTTCTAGAACATCAACAACATCTTCATCTGCAGTAGCAGCCACCTCTACTCTTCTCCCCACCAAGAGGAAGAGGGAGCCAGAAGAAGTAAAGGTGAAAGTGGAAGTAAAAATGGAACAAGAAGAACTGGTAGAGGACTCGTCAAGTAACAAGCGCCCCAGAATTAAGGAAGAGAAGGAGGAAGAACACAAAGAAACACATCACCTCTCCCTCCCATGTAAAGAAGAAGAAGACGATGGTGAAGAAGAGGAATATGAGGAAGAGGAGGATGAGGAAGAATATGAAGACAGAGTGGACGACGACACTGCAGAGAAAATGGAAAATCTTTTGGTGCAACTGGACAATACTACCAAAAACATCAAACTGAAAAACCCCCTAAGGGAACATGACATGGCAGTTTCACACTATGAGCATGAATTTGAGGTACAAAATACTGTCAATTTTAGTTTTGGAGTACTATCTGATATTGGGTTCCTGATCAACCGTGAAGCCGTTTCTAGGTGGGGTAATACACCCCCACCAAAAGAGTTTGGCGACATGGAGATTGGATCTCTTACAGTTAACCAGTTGCTCCACAAGTGTGATAATTTTGTACAGGCTGTAGTACAGAAAGTGAAGGAAGATATAACCCCTTCTATTGAAGTTACAATAGATAGTTTGATTGATGATCCTTGTTGGTAA

SEQ ID NO: 86 - protein, 278 aa, Artificial Sequence
  Whispovirus wssv. >P5MICT165088 (VP32)
MSLFISPFFRKIGTTTMSLAVTEDYGHNEKLIKRLQTSVYHTPLLGADHVMKSISDYIISRRFMNYTNLLKQVEYVFDEETGAVIANICLLKILERCAQKGGIYDAPEDVAFFNSKMGEVTRLFTIIGGRPNMTVRVNFKHGQTNNPAYGYLTDDNDTTTVTPPVTPPPSPAARRSPFFTRTLISESSSVDHYVLMHDNPKRSSFKVYDIHAETFPHKAPSVPTFPPKTSFEISDVTLDCSMEIFSRDRDVLDNVHDYIANDPVPFLVDVVHRGSSLR

SEQ ID NO: 87 - protein, 837 aa, Artificial Sequence
  Whispovirus wssv. >P5MICG165088 (VP32)
ATGTCTTTGTTTATTTCCCCCTTTTTTAGAAAAATTGGAACAACAACAATGTCGTTGGCTGTGACAGAAGATTACGGGCACAATGAAAAGTTGATCAAACGGTTACAAACCTCTGTATATCACACCCCTCTATTAGGTGCAGACCATGTAATGAAATCCATATCAGACTACATAATTTCTCGTCGATTCATGAACTACACAAATTTATTAAAACAAGTTGAATATGTTTTCGATGAAGAAACAGGAGCAGTTATAGCTAATATCTGTCTGTTAAAAATCCTAGAAAGATGCGCACAGAAAGGAGGAATATATGATGCACCAGAAGATGTTGCATTCTTCAATTCTAAGATGGGGGAAGTAACGCGCCTATTTACTATTATAGGAGGTAGGCCCAATATGACGGTGCGGGTTAATTTTAAACATGGGCAGACAAATAATCCTGCCTATGGTTATCTCACAGATGATAATGATACTACTACTGTTACTCCTCCTGTTACTCCTCCTCCATCTCCAGCTGCAAGAAGATCCCCTTTTTTCACACGCACTCTCATATCCGAGTCGTCTTCAGTTGACCATTATGTATTGATGCATGATAACCCAAAAAGATCTTCATTTAAGGTGTATGATATTCACGCAGAAACCTTTCCCCATAAAGCTCCTTCTGTTCCTACCTTCCCCCCTAAAACCTCGTTTGAAATTTCTGACGTGACTCTCGATTGTTCAATGGAGATTTTTTCACGAGACAGGGATGTTTTAGACAATGTTCACGACTATATTGCTAACGACCCCGTACCATTTTTAGTGGATGTTGTGCACCGTGGATCTAGTCTCCGTTGA

SEQ ID NO: 88 - protein, 565 aa, Artificial Sequence
  Whispovirus wssv. >P5MICT165388
MARSVGLLSVTPEYDTFKYIKMEEFKTLKVKNGFTISGENPDKYEHILLSFKSVDRVTKSELRDGLYIVRLKDKEVLHIKNGVHRLRQLTGDNTLQVGLKYTHNLPRLGSLLQDDGCEDYGEKWNESLPIDMQNINKIVKEKALLSDKNFKFSPLYRLLHERLSNAAVKKCDYMIITTDFLVGCGYTPSHCPRTLRNMEQLLVEQCGFSSRISVYDICDRLTYKGAYIANPITGSYSNMCLIVPMDKLGLIFYNSTHPSAKSIGNYMSSLFNATVIYANERDNLQMDNFRREIKFAENEVNMKEEELKELRKRCAVSEEQRISLRDVHKKSSIATSRYDGGACLVFAFSDRDFSLLCRTNGNGSFYSATEEGIRYVSSPEYKKRDVGERRPRLIMSITGSDAPICIRDSVRNHFKTRLFSRTSGNSITFAVPPGERELMEMVREVTGTDIKIFMDNGKVYQNGAEINVIDPTSKEYKELLKREENLPEDERKRLRRERRMIFNTSRAISMYNEERGDGGSGGETSEDGDGNGSTSSKGEKRKREENEGNEYVVLLNKACKDIKVC

SEQ ID NO: 89 - protein, 1698 aa, Artificial Sequence
  Whispovirus wssv. >P5MICG165388 sequence_region_id=4491 start=285774 stop=284077 length=1698
ATGGCAAGGTCTGTAGGTTTATTATCTGTGACACCCGAGTATGACACATTTAAGTATATCAAAATGGAAGAATTCAAGACTTTAAAGGTAAAAAATGGATTCACTATTTCTGGTGAAAACCCTGACAAATACGAACATATTCTATTATCATTCAAATCTGTTGATAGGGTTACAAAAAGTGAATTAAGGGACGGACTATATATAGTCCGTCTAAAAGATAAGGAAGTACTTCACATAAAAAACGGAGTGCATAGACTGAGACAATTGACAGGCGACAATACTCTTCAAGTCGGATTAAAGTATACTCACAATCTCCCCAGGTTAGGGAGTTTATTGCAAGATGATGGGTGTGAGGATTATGGGGAAAAGTGGAACGAATCACTCCCCATTGATATGCAAAATATCAACAAAATCGTTAAAGAAAAGGCCCTTCTTAGTGACAAAAACTTTAAATTTTCTCCTCTCTACAGGCTTTTACACGAAAGACTTTCTAATGCAGCTGTGAAAAAATGTGACTATATGATAATAACCACTGACTTTTTAGTAGGGTGTGGCTACACGCCGAGCCATTGCCCTAGAACACTTCGTAACATGGAACAATTATTGGTGGAACAATGTGGCTTTTCTTCCCGCATATCAGTGTATGATATATGTGATAGGTTAACATACAAAGGGGCCTACATTGCAAACCCAATCACAGGCAGTTACTCCAACATGTGCCTAATTGTTCCAATGGATAAACTAGGTTTGATTTTCTACAACAGTACACACCCATCAGCTAAAAGTATTGGAAATTATATGTCATCTCTTTTCAATGCAACCGTCATATACGCAAATGAAAGGGATAATTTACAGATGGATAATTTCAGAAGAGAAATAAAGTTTGCAGAGAATGAAGTAAATATGAAGGAAGAAGAACTGAAGGAATTGAGGAAACGTTGTGCCGTCTCTGAAGAACAAAGGATTTCTTTGAGGGATGTGCACAAAAAATCATCGATTGCGACATCCCGCTATGATGGTGGAGCCTGCTTAGTGTTTGCTTTTTCTGACCGAGATTTCTCCTTGCTATGCAGAACCAACGGAAATGGTTCCTTTTATTCTGCAACAGAAGAAGGAATCAGGTATGTCTCTTCACCTGAATATAAAAAGAGAGATGTGGGAGAACGTAGGCCCCGTTTGATCATGTCCATAACTGGATCGGATGCCCCTATATGTATTAGGGACAGTGTACGAAACCACTTCAAGACGAGACTTTTCTCCCGCACCAGTGGCAATAGTATAACCTTTGCAGTCCCTCCAGGAGAAAGGGAACTAATGGAAATGGTCAGAGAGGTAACAGGAACAGACATCAAAATTTTCATGGATAATGGAAAAGTATATCAAAATGGTGCCGAAATCAATGTGATTGATCCGACATCTAAGGAATACAAAGAGTTACTCAAAAGGGAAGAAAACTTGCCCGAAGACGAACGGAAGCGTTTGCGGCGAGAACGACGCATGATTTTCAATACGTCAAGGGCAATTTCCATGTATAATGAAGAACGTGGAGATGGAGGAAGTGGAGGAGAAACTTCAGAAGATGGAGATGGAAACGGCAGCACCAGCAGTAAAGGAGAGAAAAGGAAAAGAGAAGAAAATGAAGGGAATGAATATGTAGTCCTTTTGAACAAGGCTTGTAAAGACATAAAAGTTTGCTAA

SEQ ID NO: 90 - protein, 538 aa, Artificial Sequence
  Whispovirus wssv. >P5MICT165399
MEDFKQLKVKNGICLSGENTENYERVLLTFKSVKSVRRSELKEGHFIVRLRDKEVLHIKNGNERLRQLTGDPTLQIGLKYTSSLPKQGSFLEDEDPNYGKKWNESLPSPFQEMNKIVEEKALVNDKNFKFSPLYRIIHERLSNAAVKKCDYMIITTDFLVGCGFSPRNCTRTLKNMEQVLVQHGGTSSRVSVYDICDRLTYNGLSIANPIVGSFSNMCLIVPMDKLGLLFYNSTHPSAKSIGNYMSCLFNAAVVYTLEKSNQKLDNFEKEIRFAKNEVNLLVSERSVLEEKLKESKKLYAASEEQRISLRDVHKKSSIASSRYDGGACLVFAFSDRDFSLLCRTNGNGSFYSATEEGIRYVSSDDYRKRDVDERRPRLVMSITGSDAPICIRDSIRNHFNNHFIASGKGNEISFIDPPNERLLMEMVREVTGSDIKIFMDNGKVYQDGVEIKVIDPSSKEGKDIIKKEETLPEEERKRLRRERRMIFNTVKAIETYNEERGEEEEVATSSGGTKRKREEKEGDYVALLNKACKEIKVC

SEQ ID NO: 91 - protein, 1617 aa, Artificial Sequence
  Whispovirus wssv. >P5MICG165399 sequence_region_id=4491 start=291299 stop=289683 length=1617
ATGGAAGACTTTAAACAATTAAAAGTAAAAAATGGTATTTGTTTGTCTGGGGAAAATACCGAAAATTATGAACGGGTACTATTAACATTCAAATCAGTCAAGAGTGTCAGGAGAAGTGAGCTAAAGGAAGGACATTTTATAGTTCGTCTTAGAGACAAGGAAGTACTCCACATCAAGAACGGTAACGAAAGATTGAGACAATTAACAGGAGATCCTACGCTTCAGATTGGACTAAAATACACATCCAGTCTCCCAAAACAAGGTAGTTTCTTAGAAGATGAAGACCCTAATTATGGAAAAAAATGGAACGAATCACTACCAAGCCCATTCCAGGAAATGAACAAAATTGTGGAAGAAAAGGCTCTAGTTAATGACAAGAACTTTAAATTTTCACCCCTATACAGAATCATACATGAACGTCTTTCAAATGCGGCCGTTAAGAAATGTGATTATATGATAATCACAACAGACTTCTTAGTAGGGTGTGGGTTTTCTCCTAGAAATTGTACCCGTACTCTTAAGAATATGGAACAAGTGTTAGTGCAACACGGTGGTACCTCTTCTCGTGTATCAGTGTATGATATCTGTGATAGGTTAACGTACAATGGCTTAAGTATCGCAAACCCCATAGTTGGCAGTTTTTCAAATATGTGCCTAATTGTACCAATGGATAAACTTGGATTACTTTTCTACAACAGCACACACCCGTCAGCTAAAAGCATTGGAAATTACATGTCATGCCTTTTCAATGCTGCAGTTGTATACACGCTAGAAAAGAGTAATCAAAAATTAGATAATTTCGAAAAGGAAATCAGATTTGCAAAAAATGAAGTCAACCTTCTAGTTAGCGAAAGAAGTGTTCTGGAAGAAAAACTTAAAGAATCCAAAAAGCTATATGCTGCCTCAGAAGAACAAAGGATTTCTCTTCGAGATGTGCATAAAAAGTCCTCAATTGCATCATCCAGATATGACGGCGGTGCCTGTCTGGTCTTTGCCTTTTCTGACCGAGATTTCTCCTTGTTGTGCAGAACCAATGGAAATGGTTCCTTTTACTCTGCCACAGAAGAAGGAATCAGATACGTCTCTTCGGACGACTACAGAAAGAGGGACGTGGATGAACGTAGGCCCAGATTGGTCATGTCCATAACTGGCTCAGATGCACCTATATGCATCAGAGATAGTATACGAAACCATTTTAATAACCATTTCATTGCATCCGGAAAGGGTAATGAAATATCATTCATCGATCCTCCGAATGAAAGGTTGTTGATGGAGATGGTCAGAGAGGTTACTGGATCAGACATCAAAATCTTCATGGATAATGGAAAAGTATATCAAGATGGTGTAGAAATAAAAGTGATTGACCCCTCTTCTAAAGAAGGCAAGGACATAATAAAAAAGGAAGAAACATTACCAGAGGAGGAAAGGAAGCGTCTGCGCCGAGAGCGTCGCATGATTTTCAACACAGTTAAGGCAATTGAGACGTACAACGAGGAACGTGGGGAAGAAGAAGAAGTAGCCACAAGCAGTGGAGGAACAAAGAGAAAGAGGGAGGAGAAAGAAGGCGATTATGTTGCCCTTTTGAACAAGGCATGCAAAGAAATTAAAGTTTGTTGA

SEQ ID NO: 92 - protein, 381 aa, Artificial Sequence
  Whispovirus wssv. >P5MICT165458
MEDFKQLKVKNGICLSGENTENYERVLLTFKSVKSVRRSELKEGHFIVRLRDKEVLHIKNGNERLRQLTGDPTLQIGLKYTSSLPKQGSFLEDEDPNYGKKWNESLPSPFQEMNKIVEEKALVNDKNFKFSPLYRIIHERLSNAAVKKCDYMIITTDFLVGCGFSPRNCTRTLKNMEQVLVQHGGTSSRVSVYDICDRLTYNGLSIANPIVGSFSNMCLIVPMDKLGLLFYNSTHPSAKSIGNYMSCLFNAAVVYSLEKSNQKLDNFEKEIRFAKNEVNLLVSERSVLEEKLKESKKLYAASEEQRISLRDVHKKSSIASSRYDGGAVWSLPFLTEISPCCAEPMEMVPFTLPQKKESDTSLRTTTERGTWMNVGPDWSCP

SEQ ID NO: 93 - protein, 1146 aa, Artificial Sequence
  Whispovirus wssv. >P5MICG165458 sequence_region_id=4492 start=19780 stop=18635 length=1146
ATGGAAGACTTTAAACAATTAAAAGTAAAAAATGGTATTTGTTTGTCTGGGGAAAATACCGAAAATTATGAACGGGTACTATTAACATTCAAATCAGTCAAGAGTGTCAGGAGAAGTGAGCTAAAGGAAGGACATTTTATAGTTCGTCTTAGAGACAAGGAAGTACTCCACATCAAGAACGGTAACGAAAGATTGAGACAATTAACAGGAGATCCTACGCTTCAGATTGGACTAAAATACACATCCAGTCTCCCAAAACAAGGTAGTTTCTTAGAAGATGAAGACCCTAATTATGGAAAAAAATGGAACGAATCACTACCAAGCCCATTCCAGGAAATGAACAAAATTGTGGAAGAAAAGGCTCTAGTTAATGACAAGAACTTTAAATTTTCACCCCTATACAGAATCATACATGAACGTCTTTCAAATGCGGCCGTTAAGAAATGTGATTATATGATAATCACAACAGACTTCTTAGTAGGGTGTGGGTTTTCTCCTAGAAATTGTACCCGTACTCTTAAGAATATGGAACAAGTGTTAGTGCAACACGGTGGTACCTCTTCTCGTGTATCAGTGTATGATATCTGTGATAGGTTAACGTACAATGGCTTAAGTATCGCAAACCCCATAGTTGGCAGTTTTTCAAATATGTGCCTAATTGTACCAATGGATAAACTTGGATTACTTTTCTACAACAGCACACACCCGTCAGCTAAAAGCATTGGAAATTACATGTCATGCCTTTTCAATGCTGCAGTTGTATACTCACTAGAAAAGAGTAATCAAAAATTAGATAATTTCGAAAAGGAAATCAGATTTGCAAAAAATGAAGTCAACCTTCTAGTTAGCGAAAGAAGTGTTCTGGAAGAAAAACTTAAAGAATCCAAAAAGCTATATGCTGCCTCAGAAGAACAAAGGATTTCTCTTCGAGATGTGCATAAAAAGTCCTCAATTGCATCATCCAGATATGACGGCGGTGCTGTCTGGTCTTTGCCTTTTCTGACCGAGATTTCTCCTTGTTGTGCAGAACCAATGGAAATGGTTCCTTTTACTCTGCCACAGAAGAAGGAATCAGATACGTCTCTTCGGACGACTACAGAAAGAGGGACGTGGATGAACGTAGGCCCAGATTGGTCATGTCCATAA

SEQ ID NO: 94 - protein, 208 aa, Artificial Sequence
  Whispovirus wssv. >P5MICT165481 (VP24)
MHMWGVYAAILAGLTLILVVISIVVTNIELNKKLDKKDKDAYPVESEIINLTINGVARGNHFNFVNGTLQTRNYGKVYVAGQGTSDSELVKRKGDIILTSLLGDGDHTLNVNKAESKELELYARVYNNTKRDITVDSVSLSPGLNATGREFSANKFVLYFKPTVLKKNRINTLVFGATFDEDIDDTNRHYLLSMRFSPGNDLFKVGEK

SEQ ID NO: 95 - protein, 627 aa, Artificial Sequence
  Whispovirus wssv. >P5MICG165481 (VP24)
ATGCACATGTGGGGGGTTTACGCCGCTATACTGGCGGGTTTGACATTGATACTCGTGGTTATATCTATAGTTGTAACCAACATAGAACTTAACAAGAAATTGGACAAGAAGGATAAAGACGCCTACCCTGTTGAATCTGAAATAATAAACTTGACCATTAACGGTGTTGCTAGAGGAAACCACTTTAACTTTGTAAACGGCACATTACAAACCAGGAACTATGGAAAGGTATATGTAGCTGGCCAAGGAACGTCCGATTCTGAACTGGTAAAAAGGAAAGGAGACATAATCCTCACATCTTTACTTGGAGACGGAGACCACACACTAAATGTAAACAAAGCCGAATCTAAAGAATTAGAATTGTATGCAAGAGTATACAATAATACAAAGAGGGATATAACAGTGGACTCTGTTTCACTGTCTCCAGGTCTAAATGCTACAGGAAGGGAATTTTCAGCTAACAAATTTGTATTATATTTCAAACCAACAGTTTTGAAGAAAAATAGGATCAACACACTTGTGTTTGGAGCAACGTTTGACGAAGACATCGATGATACAAATAGGCATTATCTGTTAAGTATGCGATTTTCTCCTGGCAATGATCTGTTTAAGGTTGGGGAAAAATAA

SEQ ID NO: 96 - protein, 891 aa, Artificial Sequence
  Whispovirus wssv. >P5MICT165194 (VP22)
MTRHGVLVPKGRSRHVILGNVDYTFCTTDNNCVSLDIDFKDNITDQNIQLLNKKLGKKTAKKIKKEDAPETKENSDEDIYATKEFEQTIKGLQTKKGATEENAIAAAAAAATAAAVEKAMLSESEGKSMVINRARMVLSKRDTSQKQFTALKNRESFFSVLIFETGSVIVVGLQDPSLTKLCVIKATTDIADILQKNISVANVSIVNTVSTFNRFHLNFIRLGKFFERNCISYSYNPETFPGMFFKLRVPAKPLLPGETIGEYYTKVAMMRDSKDPNFKMSDWLRIKTALTFKVGKITVLGEGESGCGDVSVVSKLLFGLFHYFMDNNIKMSPKEAQRVREKYGIPHLEWYLYIDMLLHSYPYVKPSAEQVKRAMVDQQHISEVDRTYYGTKNSMDAAMSANLVPSKEESISFIKKIRSQQLFGHLCKPSKETTRRAIDTLSFDPINQDRWWNKNDQYYGKERCDPFSVARLVSVSENTNSMMNSRISCQGKWWLDENEYKDKLDHIVDLCTEEIVEECESKGFIASPFLRKHQKEKIPTPYVLLARACNQKNGNKMSINNNSNYLSGSSRAKRNAKLQEKHRVTLARLNTMMASYRFLNNYISTDIAPDFAKLFGNDVYSLLHLMTNLPKSRGHALTYNERALSSNESTYKTPGNAYFSTLFEKSIINNQETANKGNNRKRKFSRIGQEKSSFLCNACGVNLNKGSDEIIKGICTSCDQNSTSYIENALSDINRDKKIKRFKAAATHPPVKQELVDSLSSSSSPSSSSSQTSNKNNRCTPSDFIDYVYKFTDETTGAPKVGLVFKMCDILASLASRRGMEDRPTANYRTSLHSATQNKTNLNKLLVSAIKETGATETEAQIFNKIIGSEKGLSILCQLVERRNKDNNVFD

SEQ ID NO: 97 - protein, 2676 aa, Artificial Sequence
  Whispovirus wssv. >P5MICG165194 (VP22)
ATGACGAGACATGGTGTGCTTGTTCCAAAAGGCCGTTCTAGGCATGTTATCCTAGGAAATGTCGACTACACTTTCTGTACTACTGACAATAATTGTGTCAGTCTAGACATCGATTTCAAGGACAATATCACAGACCAAAACATTCAGTTATTGAACAAGAAATTGGGTAAGAAAACAGCAAAGAAAATAAAGAAGGAAGATGCACCTGAAACAAAGGAAAATAGTGACGAAGACATATACGCCACCAAGGAATTCGAACAGACAATAAAAGGTCTACAGACAAAAAAAGGTGCCACCGAGGAAAACGCCATCGCGGCCGCAGCTGCCGCTGCCACTGCTGCTGCGGTAGAAAAGGCTATGCTATCAGAAAGTGAAGGAAAATCAATGGTCATCAACAGAGCTAGAATGGTGCTTTCTAAGCGAGACACGTCCCAGAAACAGTTCACTGCATTGAAGAACAGGGAATCTTTCTTCAGTGTTTTGATATTTGAAACTGGATCAGTGATAGTTGTCGGGCTTCAAGATCCTTCGCTTACAAAATTGTGTGTGATTAAAGCCACGACTGATATTGCTGATATTCTACAGAAAAACATCAGTGTGGCTAACGTGTCTATAGTGAATACAGTGTCCACTTTTAATAGATTCCACTTGAACTTTATTCGACTCGGGAAATTCTTCGAAAGAAATTGCATCTCTTACAGTTATAACCCAGAAACGTTCCCCGGTATGTTTTTCAAGCTGCGAGTGCCCGCAAAGCCTCTCTTGCCTGGAGAGACTATAGGGGAATACTACACAAAGGTTGCAATGATGCGCGATAGTAAGGATCCCAATTTTAAAATGTCTGACTGGTTGAGGATAAAAACTGCATTAACATTTAAAGTTGGGAAAATTACTGTGCTCGGAGAAGGAGAGAGTGGGTGCGGTGATGTTTCTGTCGTATCCAAATTACTATTTGGTTTATTCCATTACTTTATGGACAACAACATTAAAATGTCCCCCAAAGAAGCACAAAGAGTCAGAGAAAAATACGGCATCCCGCATCTAGAATGGTACTTGTACATTGACATGTTGCTCCACTCCTACCCGTACGTCAAACCATCGGCCGAGCAAGTGAAAAGGGCGATGGTGGACCAACAACATATTTCTGAAGTGGATAGGACATACTATGGAACAAAGAACAGTATGGACGCTGCCATGTCTGCAAATTTAGTGCCTTCAAAAGAAGAGAGTATCTCCTTCATTAAAAAAATAAGATCACAACAACTTTTTGGACATTTGTGTAAACCTTCAAAAGAAACTACTCGACGTGCTATAGACACACTTTCTTTCGATCCTATAAACCAAGACAGGTGGTGGAATAAAAATGACCAATATTACGGTAAAGAGAGATGTGACCCGTTTTCTGTTGCACGTTTAGTGTCTGTTTCTGAAAATACAAACAGTATGATGAATAGTCGCATTTCTTGTCAAGGGAAATGGTGGCTAGATGAAAACGAATACAAGGATAAACTTGATCATATTGTGGATTTGTGTACAGAAGAAATAGTGGAGGAATGTGAATCAAAGGGTTTTATTGCCTCCCCATTTTTGAGGAAGCACCAGAAGGAAAAAATACCAACGCCTTATGTTTTATTAGCGAGAGCCTGTAATCAAAAAAATGGTAACAAAATGAGTATTAACAATAATAGTAACTATTTGTCGGGTTCAAGTAGGGCGAAGAGGAATGCAAAACTACAGGAAAAACACCGTGTAACTTTAGCCAGGTTGAACACGATGATGGCGTCGTACCGATTTTTGAATAATTACATCTCAACAGACATTGCACCTGATTTTGCCAAGTTATTTGGTAATGATGTATATAGTTTATTACATTTAATGACAAACTTGCCTAAATCCCGTGGACATGCTCTAACATACAACGAAAGGGCCCTTTCAAGTAATGAAAGTACATATAAAACACCTGGAAATGCATACTTTAGTACTCTATTTGAAAAATCCATTATAAATAACCAAGAAACTGCTAATAAAGGTAACAATAGAAAACGTAAATTTTCTCGAATCGGACAAGAAAAGAGCTCTTTTCTGTGCAACGCGTGTGGTGTCAATTTGAACAAGGGTAGTGATGAAATCATAAAGGGTATTTGTACAAGTTGCGATCAAAATAGTACCAGTTACATAGAGAATGCATTATCTGACATTAACAGAGACAAGAAGATTAAACGTTTTAAAGCAGCTGCAACCCATCCGCCAGTGAAGCAAGAATTGGTAGATTCTTTATCCTCCTCTTCATCTCCTTCTTCTTCTTCTTCTCAGACGTCTAACAAGAACAATAGATGCACCCCTAGTGATTTTATAGATTATGTGTACAAATTCACTGACGAAACAACAGGTGCTCCAAAGGTGGGCTTAGTGTTTAAAATGTGTGATATTCTTGCATCCTTAGCAAGCAGGAGAGGGATGGAAGATCGTCCCACAGCCAACTATAGAACCTCCTTACATTCAGCTACTCAAAATAAAACCAATTTGAATAAACTATTAGTTTCTGCTATCAAGGAAACAGGAGCCACTGAAACTGAAGCACAGATATTCAACAAGATTATTGGTAGTGAAAAGGGACTATCAATTCTCTGTCAACTTGTGGAAAGGAGGAACAAAGACAATAATGTCTTCGACTGA

SEQ ID NO: 98 - protein, 500 aa, Artificial Sequence
  Whispovirus wssv. >P5MICT165730
MVYKGFVSPSFITIRTMTSNRPTTSPLSFSEGFSLSGDKYDTYEDILLEQFNCFKTSSPSSARKSEIEDKTLIFQLKEGEKFHLAKGIEELREILDDNSATIEPIISPTTFNDRNELLNHEGDISSSPLYTQIMKHISPEHDIYELDLIVGTDLLFGLGVNLRNVSKLMKKISYGTLNVVDVCHRKFFNNRIIVNPISSSFSKNVCIIPLFSAAEEFSSLGECRDLFNGICDDVERYINSYFFYPENTTTTTTAPSSPEMEIADEEEQSPKTIKRNDNASRNWSGVCLIFEVFKNTYYIINRGDRGGSFEKAVKSAISSIKEKRCKITDINGNKPRLVMVITGCYTELYFKDALKQIGENRRKFLKMNGNYFSLIDEQADLIEFAMSVSGAGERIFVNGLGMFQNRKMIPVIDPLTYENVVCGEHDIQKEDAILSVRRAIADYNDFVSKNKRGKKRSAEEENEDEDADASSSSSSSPPPSSPPAHKKSRLPDEGEKCTLC

SEQ ID NO: 99 - protein, 1503 aa, Artificial Sequence
  Whispovirus wssv. >P5MICG165730 sequence_region_id=4492 start=173709 stop=175211 length=1503
ATGGTATATAAAGGCTTTGTATCTCCATCATTTATCACTATTCGTACGATGACGTCCAACAGACCAACAACATCCCCTCTTTCGTTCTCTGAAGGCTTCTCGCTTTCAGGGGATAAGTATGATACGTATGAGGATATCTTACTTGAACAATTCAACTGTTTCAAGACATCTTCTCCTTCTTCTGCTCGTAAAAGTGAAATAGAGGATAAAACTTTAATCTTTCAACTTAAAGAAGGAGAAAAATTCCATCTTGCAAAGGGCATAGAAGAGCTCCGTGAGATTCTAGACGATAATTCTGCAACAATTGAACCTATTATTTCTCCAACAACATTCAATGACAGAAACGAATTACTAAACCACGAGGGAGATATATCCTCAAGTCCCCTATATACTCAGATAATGAAGCATATTTCACCAGAGCATGATATTTATGAATTGGACCTTATTGTTGGCACTGATTTGCTTTTTGGTCTAGGTGTGAATCTACGCAACGTTTCTAAACTGATGAAGAAAATATCGTATGGTACTTTAAATGTAGTTGATGTGTGCCACAGAAAATTTTTCAACAATAGGATTATAGTTAATCCCATTTCTTCGTCATTCTCAAAAAATGTGTGTATTATTCCTCTATTTTCTGCAGCTGAAGAATTTTCGTCTCTGGGGGAATGCAGGGATTTATTCAACGGTATTTGTGATGACGTAGAGAGATATATCAACTCTTATTTTTTCTACCCTGAAAATACTACTACTACTACTACTGCTCCTTCGTCGCCCGAAATGGAAATTGCAGATGAGGAAGAACAATCCCCAAAAACTATAAAGAGAAATGACAACGCAAGTAGAAACTGGTCTGGTGTCTGTTTGATTTTTGAAGTATTTAAAAACACGTACTACATTATTAATAGAGGAGATAGAGGAGGTTCTTTTGAAAAGGCTGTGAAGAGTGCAATTTCTTCTATCAAGGAAAAGAGATGTAAAATCACAGATATTAATGGTAATAAACCTCGATTGGTTATGGTGATAACTGGGTGTTATACAGAATTGTACTTCAAAGATGCACTTAAACAGATTGGAGAAAACAGGCGCAAATTTTTGAAAATGAATGGGAATTACTTTTCTCTGATTGATGAACAAGCAGATCTAATCGAATTCGCGATGAGTGTTTCTGGTGCCGGGGAGAGGATTTTTGTTAACGGTTTGGGGATGTTCCAGAACCGTAAAATGATACCTGTAATTGATCCTCTCACATATGAAAATGTTGTATGTGGTGAGCATGATATACAAAAAGAAGATGCTATTCTTTCTGTAAGGAGAGCTATTGCAGACTATAATGACTTTGTAAGTAAGAACAAGAGAGGGAAGAAACGCAGCGCAGAAGAAGAAAATGAAGATGAAGATGCAGACGCTAGCAGCAGCAGCAGCAGCAGTCCTCCTCCTTCTTCTCCTCCTGCACATAAAAAATCACGTCTTCCGGATGAAGGCGAAAAATGTACACTCTGTTAA

SEQ ID NO: 100 - protein, 68 aa, Artificial Sequence; identical to SEQ ID NO: 66
  Whispovirus wssv. >P5MICT165868

SEQ ID NO: 101 - protein, 207 aa, Artificial Sequence; identical to SEQ ID NO: 67
  Whispovirus wssv. >P5MICG165868 sequence_region_id=4492 start=263142 stop=262936 length=207

SEQ ID NO: 102 - protein, 121 aa, Artificial Sequence
  Whispovirus wssv. >P5MICT165896
MATTTNTLPFGRTGAQAAGPSYTMEDLEGSMSMARMGLFLIVAISIGILVLAVMNVWMGPKKDSDSDTDKDTDDDDDTANDNDDEDKYKNRTRDMMLLAGSALLFLVSAATVFMSYPKRRQ

SEQ ID NO: 103 - protein, 360 aa, Artificial Sequence
  Whispovirus wssv. >P5MICG165896 sequence_region_id=4492 start=276260 stop=275895 length=366
ATGGCCACCACGACTAACACTCTTCCTTTCGGCAGGACCGGAGCCCAGGCCGCTGGCCCTTCTTACACCATGGAAGATCTTGAAGGCTCCATGTCTATGGCTCGCATGGGTCTCTTTTTGATCGTTGCTATCTCAATTGGTATCCTCGTCCTGGCCGTCATGAATGTATGGATGGGACCAAAGAAGGACAGCGATTCTGACACTGATAAGGACACCGATGATGATGACGACACTGCCAACGATAACGATGATGAGGACAAATATAAGAACAGGACCAGGGATATGATGCTTCTGGCTGGGTCCGCTCTTCTGTTCCTCGTTTCCGCCGCCACCGTTTTTATGTCTTACCCCAAGAGGAGG

The invention claimed is:

1. A double-stranded RNA particle (dsRP) comprising, a recombinant double-stranded RNA molecule (dsRNA) comprising
   at least one heterologous sub-sequence of RNA that binds to a target sequence, and
   at least 90% sequence identity to a wild type L-A virus genome, not counting the sub-sequence of RNA that binds to the target sequence, wherein the wild type L-A virus genome encodes a gag protein and an RNA-dependent RNA polymerase, and is sufficient for autonomous replication of the dsRP in a host cell, and
   encapsidated in a capsid.

2. The dsRNA particle of claim 1 wherein the host cell is a yeast cell, and the dsRNA particle is less than 100 nm in diameter.

3. The dsRNA particle of claim 2 wherein the dsRNA molecule is less than about 6 kb.

4. The dsRNA particle of claim 2 wherein the double-stranded RNA molecule comprises at least 98% of an L-A virus genome.

5. The dsRNA particle of claim 1 wherein the gag protein and the RNA-dependent RNA polymerase comprise a Gag-Pol fusion protein.

6. The dsRP of claim 1 wherein the target sequence is an RNA sequence coded for by a pathogen genome.

7. The dsRP of claim 6 wherein the target sequence is a critical gene of the pathogen or a portion thereof.

8. The dsRNA particle of claim 6 wherein the target sequence is a regulatory element of a gene that codes for a critical pathogen protein.

9. The dsRNA particle of claim 8 wherein the dsRNA particle provides an at least partial immunity in the salmonid fish against IPN for at least 60 days.

10. The dsRNA particle of claim 9 wherein the dsRNA particle provides an at least partial immunity in the salmonid fish against IPN for at least 75 days.

11. The dsRNA particle of claim 8 wherein the dsRNA particle provides an at least partial immunity in the penaeid shrimp against WSS for at least 7 days.

12. The dsRNA particle of claim 11 wherein the dsRNA particle provides an at least partial immunity in the penaeid shrimp against WSS for at least 90 days.

13. The dsRNA particle of claim 1 wherein the target sequence is an RNA sequence of a pathogen that causes Infectious Pancreatic Necrosis (IPN) disease in salmonid fish.

14. The dsRNA particle of claim 13 wherein the target sequence is an RNA sequence coded for by a sequence selected from the group consisting of: an at least 10 bp portion of any one or more of the nucleotide sequences found in SEQ ID NOs: 2-103.

15. The dsRNA particle of claim 1 wherein the target sequence is an RNA sequence of a pathogen that causes white spot syndrome (WSS) in penaeid shrimp.

16. The dsRNA particle of claim 1 wherein the target sequence is an RNA sequence of a pathogen that causes disease in an animal of the genus *Sus*.

17. The dsRNA particle of claim 16 wherein the dsRNA particle provides an at least partial immunity in the animal of the genus *Sus* against said disease for at least 60 days.

18. The dsRNA particle of claim 1 wherein the sub-sequence of RNA binds to an RNA target sequence and disrupts a critical function of a viral or bacterial pathogen.

19. The dsRNA particle of claim 1 wherein the sub-sequence of RNA binds to an RNA target that is a unique sequence in a pathogen genome.

20. The dsRNA particle of claim 1 wherein the RNA molecule further comprises a sequence complementary to the at least one heterologous sub-sequence of RNA, and a separator sequence located between the RNA sub-sequence and the complementary sequence so that the RNA sub-sequence and complementary sequence can bind and form a hairpin structure.

21. The dsRNA particle of claim 1 wherein the double-stranded RNA particle further encodes a viral particle binding site (VBS) and an internal replication enhancer.

22. The dsRNA particle of claim 1 wherein the RNA sub-sequence has a length of up to 2 kb.

23. A formulation comprising a dsRP of claim 1.

24. A formulation comprising a dsRP of claim 13.

25. A formulation comprising a dsRP of claim 15.

26. A formulation comprising a dsRP of claim 14.

27. A formulation comprising a dsRP of claim 16.

28. A method of treating an animal disease comprising administering to an animal to be treated a double-stranded RNA particle (dsRP) of claim 1.

29. The method of claim 28 wherein the dsRP is derived from L-A virus and is less than 100 nm in diameter.

30. The method of claim 29 wherein the animal is selected from the group consisting of: a peneid shrimp, a salmonid fish, or an animal of the genus *Sus*.

31. The method of claim 30 wherein the animal is a peneid shrimp and the disease is white spot disease.

* * * * *